United States Patent
Nager et al.

(10) Patent No.: US 12,163,169 B2
(45) Date of Patent: Dec. 10, 2024

(54) INDUCIBLE CHIMERIC CYTOKINE RECEPTORS

(71) Applicant: Allogene Therapeutics, Inc., South San Francisco, CA (US)

(72) Inventors: Andrew Ross Nager, Mountain View, CA (US); Spencer Park, Belmont, CA (US); Javier Fernando Chaparro Riggers, San Mateo, CA (US); Regina Junhui Lin, San Mateo, CA (US); Thomas John Van Blarcom, Oakland, CA (US)

(73) Assignee: Allogene Therapeutics, Inc., South San Francisco, CA (US)

( * ) Notice: Subject to any disclaimer, the term of this patent is extended or adjusted under 35 U.S.C. 154(b) by 887 days.

(21) Appl. No.: 16/290,388

(22) Filed: Mar. 1, 2019

(65) Prior Publication Data
US 2019/0292533 A1  Sep. 26, 2019

Related U.S. Application Data

(60) Provisional application No. 62/637,600, filed on Mar. 2, 2018.

(51) Int. Cl.
| | | |
|---|---|---|
| *C12N 9/90* | (2006.01) | |
| *A61K 35/17* | (2015.01) | |
| *A61K 45/06* | (2006.01) | |
| *C07K 14/705* | (2006.01) | |
| *C07K 14/71* | (2006.01) | |
| *C07K 14/715* | (2006.01) | |
| *C07K 14/72* | (2006.01) | |
| *C12N 5/0783* | (2010.01) | |
| *A61K 38/00* | (2006.01) | |
| *A61K 48/00* | (2006.01) | |

(52) U.S. Cl.
CPC .............. *C12N 9/90* (2013.01); *A61K 35/17* (2013.01); *A61K 45/06* (2013.01); *C07K 14/70517* (2013.01); *C07K 14/70578* (2013.01); *C07K 14/71* (2013.01); *C07K 14/715* (2013.01); *C07K 14/7155* (2013.01); *C07K 14/7156* (2013.01); *C07K 14/72* (2013.01); *C12N 5/0636* (2013.01); *C12Y 502/01008* (2013.01); *A61K 38/00* (2013.01); *A61K 48/00* (2013.01); *C07K 2319/02* (2013.01); *C07K 2319/03* (2013.01); *C07K 2319/70* (2013.01)

(58) Field of Classification Search
None
See application file for complete search history.

(56) References Cited

U.S. PATENT DOCUMENTS

| | | | |
|---|---|---|---|
| 8,389,282 B2 | 3/2013 | Sadelain et al. | |
| 9,434,935 B2 | 9/2016 | Spencer et al. | |
| 9,913,882 B2 | 3/2018 | Slawin et al. | |
| 9,944,690 B2 | 4/2018 | Spencer et al. | |
| 10,287,354 B2 * | 5/2019 | Brogdon | A61K 31/436 |
| 10,336,810 B2 * | 7/2019 | Tanaka | C07K 14/7051 |
| 10,548,921 B2 * | 2/2020 | Leen | A61P 35/00 |
| 2014/0050709 A1 * | 2/2014 | Leen | A61K 39/001182 |
| | | | 435/372 |
| 2014/0087468 A1 | 3/2014 | Spencer et al. | |
| 2015/0111294 A1 | 4/2015 | Spencer et al. | |
| 2016/0175359 A1 | 6/2016 | Spencer et al. | |
| 2016/0297884 A1 | 10/2016 | Kuo et al. | |
| 2018/0037630 A1 * | 2/2018 | Tanaka | C07K 14/7155 |
| 2019/0000881 A1 | 1/2019 | Sadelain et al. | |

FOREIGN PATENT DOCUMENTS

| | | |
|---|---|---|
| CA | 2842368 A1 | 2/2013 |
| WO | 1996/004389 A1 | 2/1996 |
| WO | 98/02558 A2 † | 1/1998 |
| WO | WO-98/02558 A3 | 1/1998 |
| WO | WO2007075899 A2 | 7/2007 |
| WO | WO2011069004 A1 | 6/2011 |
| WO | 2012/138858 A1 † | 10/2012 |
| WO | WO-2014/151960 A2 | 9/2014 |
| WO | WO-2014/151960 A3 | 9/2014 |
| WO | WO-2016/055551 A1 | 4/2016 |
| WO | 2016/127257 A1 † | 8/2016 |
| WO | 2017/029512 A1 † | 2/2017 |
| WO | 2017/068360 A1 † | 4/2017 |
| WO | WO 2017/103596 * | 6/2017 |
| WO | WO2017103596 A1 | 6/2017 |
| WO | 2018/038945 A1 † | 3/2018 |
| WO | 2018/094244 A1 † | 5/2018 |
| WO | WO2018104473 A1 | 6/2018 |
| WO | 2018150187 A1 | 8/2018 |

(Continued)

OTHER PUBLICATIONS

Bajgain, Pradip, "CAR T Cell Therapy for Breast Cancer: Harnessing the Tumor Milieu to Drive T Cell Activation", Research Article, J Immunother Cancer. May 10, 2018;6(1):34. doi: 10.1186/s40425-018-0347-5.

Defour, J P, et al., "Oncogenic activation of MPL/thrombopoietin receptor by 17 mutations at W515: implications for myeloproliferative neoplasms", Leukemia 30, 1214-1216; doi:10.1038/leu.2015.271, 2016.

EPO , "International Search Report & Written Opinion", mailed on May 29, 2020 for PCT Application No. PCT/US2020/020415; 17 pages.

EPO , "International Search Report and Written Opinion", mailed on Jun. 4, 2020 for PCT Application No. PCT/US2020/020340; 15 pages.

(Continued)

*Primary Examiner* — Maria G Leavitt

(57) ABSTRACT

The present invention provides inducible chimeric cytokine receptors responsive to a ligand, e.g., a small molecule or protein, uses of such receptors for improving the functional activities of genetically modified immune cells, such as T cells, comprising the inducible chimeric cytokine receptors, and compositions comprising such cells.

8 Claims, 67 Drawing Sheets

Specification includes a Sequence Listing.

(56) References Cited

FOREIGN PATENT DOCUMENTS

| WO | 2018161064 A1 | | 9/2018 |
|---|---|---|---|
| WO | WO 2019/055946 | * | 3/2019 |
| WO | 2019102207 A1 | | 5/2019 |
| WO | WO2019118508 A1 | | 6/2019 |
| WO | 2019169290 A1 | | 9/2019 |
| WO | 2019246563 A1 | | 12/2019 |
| WO | 2020/044055 A1 | † | 3/2020 |
| WO | WO2020180664 A1 | | 9/2020 |
| WO | WO2020180694 A1 | | 9/2020 |
| WO | WO2016168612 A1 | | 10/2020 |

OTHER PUBLICATIONS

Friedmann, Michael C., et al., "Different interleukin 2 receptor beta-chain tyrosines couple to at least two signaling pathways and synergistically mediate interleukin 2-induced proliferation", Immunology; Proc. Natl. Acad. Sci. USA, vol. 93, pp. 2077-2082, Mar. 1996.

Johnson, L.A., et al., "Rational development and characterization of humanized anti-EGFR variant III chimeric antigen receptor T cells for glioblastoma", Science Translational Medicine, vol. 7, No. 275, Feb. 18, 2015, pp. 1-16, XP055362795, US ISSN: 1946-6234, DOI: 10.1126/scitranslmed.aaa4963.

Lu, Xiaohui, et al., "Dimerization by a Cytokine Receptor Is Necessary for Constitutive Activation of JAK2V617F", J Biol Chem; . Feb. 29, 2008;283(9):5258-66. doi: 10.1074/jbc. M707125200; Epub Dec. 23, 2007.

Malek, Thomas R., et al., "Interleukin-2 Receptor Signaling: At the Interface between Tolerance and Immunity", Immunity. Aug. 27, 2010; 33(2): 153-165. doi:10.1016/j.immuni.2010.08.004, 2010.

Tokarew, Nicholas, et al., "Teaching an old dog new tricks: next-generation CAR T cells", British Journal Cancer, Nature Publishing Group; 120, 26-37. https://doi.org/10.1038/s41416-018-0325-1, Nov. 6, 2018.

Varghese, Lelia N., et al., "The Thrombopoietin Receptor: Structural Basis of Traffic and Activation by Ligand, Mutations, Agonists, and Mutated Calreticulin", Frontiers in Endocrinology, Mar. 2017, vol. 8, Article 59; doi: 10.3389/fendo.2017.00059.

EPO, "International Search Report & Written Opinion", mailed for PCT/US2020/048402 on Nov. 27, 2020, 23 pages.

Saur, Sebastian J., et al., "Ubiquitination and degradation of the thrombopoietin receptor c-Mpl", Blood, Feb. 11, 2010 vol. 115, No. 6, pp. 1254-1263.

EPO, "International Search Report & Written Opinion", Mailed on Jun. 21, 2021 for International Application No. PCT/US2021/019362.

Morris, Rhiannon, et al., "The molecular details of cytokine signaling via the JAK/STAT pathway", Protein Science 2018 ; vol. 27; pp. 1984-2009;, Dec. 1, 2018.

Behrmann, I. et al. (1997). "A single STAT recruitment module in a chimeric cytokine receptor module in a chimeric cytokine receptor complex is sufficient for STAT activation," J. Blol. Chem. 272:5269-5274.

Boger, D.L. et al. (2001). "Cytokine receptor dimerization and activation: Prospects for small molecule agonists," Bioorganic & Medicinal Chemistry 9:557-562.

Boyerinas, B. et al. (2017). "Abstract 602: A novel TGF-β/IL-12R signal conversion platform that protects CAR T cells from TGF-β-mediated immune suppression and concurrently amplifies effector function," Proceedings of the American Association for Cancer Research Annual Meeting 2017; Apr. 1-5, 2017; Washington, DC. Philadelphia (PA): AACR; Cancer Res 2017;77(13 Suppl):Abstract 602, 4 total pages.

Cherkassky, L. et al. (2016). Human CAR T cells with cell-intrinsic PD-1 checkpoint blockade resist tumor-mediated inhibition, J. Clin. Invest. 126:3130-3144.

Defour, J.P. et al. (2013). "Tryptophan at the transmembrane-cytosolic junction modulates thrombopoietin receptor dimerization and activation," PNAS 110:2540-2545.

Hoyos, V. et al. (2010). Engineering CD19-specific T lymphocytes with interleukin-15 and a suicide gene to enhance their anti-lymphoma/leukemia effects and safety, Leukemia 24:1160-1170.

Hurton, L.V. et al. (2016). "Tethered IL-15 augments antitumor activity and promotes a stem-cell memory subset in tumor-specific T cells," PNAS E7788-E7797.

International Search Report mailed on May 31, 2019, for PCT Application No. PCT/US2019/020340, filed on Mar. 1, 2019, 7 pages.

Kagoya, Y. et al. (2018). A novel chimeric antigen receptor containing a JAK-STAT signaling domain mediates superior antitumor effects, Nature Med. 24:352-359.

Kloss, C. et al. (2016). "TGFBeta signaling blockade within PSMA targeted CAR human T cells for the eradication of metastatic prostate cancer," Abstract 638, Molucular Therapy vol. 24, Supplement 1, 2 total pages.

Leen, A.M. et al. (2014). "Reversal of tumor immune inhibition using a chimeric cytokine receptor," Mol. Ther. 22:1211-1220.

Leroy, E. et al. (2016). "His499 regulates dimerization and prevents oncogenic activiation by asparagine mutations of the human thrombopoietin receptor," J. Biol. Chem. 291:2974-2987.

Liu, X. et al. (2016). "A chimeric switch-receptor targeting PD1 augments the efficacy of second-generation CAR T cells in advanced solid tumors," Cancer Res. 76:1578-1590.

Matthew, E.E. et al. (2011). "Thrombopoietin receptor activation: Transmembrane helix dimerization, rotation, and allosteric modulation," FASEB J. 25:2234-2244.

Maute, R.L. et al. (2015). "Engineering high-affinity PD-1 variants for optimized immunotherapy and immuno-PET imaging," PNAS 112:E6506-E6514.

Murray, P.J. (2007). "The JAK-STAT signaling pathway: Input and output integration," J. Immunology 178:2623-2629.

Nakamura, T. et al. (1998). "A selective switch-on system for self-renewal of embryonic stem cells using chimeric cytokine receptors," Biochem. And Biophys. Res. Commun. 248:22-27.

Shum, T. et al. (2017). Constitutive signaling from an engineered IL7 receptor promotes durable tumor elimination by tumor-redirected T cells, Cancer Discovery 7:1-10.

Sukumaran, S. et al. (2018). "Enhancing the potency and specificity of engineered T cells for cancer treatment," Cancer Discovery 8:972-987.

Vong, Q. et al. (2017). "Inhibiting TGFβ signaling in CAR T-cells may significantly enhance efficacy of tumor immunotherapy," Blood 130:1791, 5 total pages.

Written Opinion of the International Searching Authority mailed on May 31, 2019, for PCT Application No. PCT/US2019/020340, filed on Mar. 1, 2019, 10 pages.

Wu, C-Y. et al. (2015). "Remote control of therapeutic T cells through a small molecule-gated chimeric receptor," Science 350:aab4077, 21 total pages.

Ajina, Adam, et al., "Strategies to Address Chimeric Antigen Receptor Tonic Signaling", Mol Cancer Ther, . Sep. 2018; 17(9):1795-1815. doi: 10.1158/1535-7163.MCT-17-1097.

Gacerez, Albert T., et al., "How Chimeric Antigen Receptor Design Affects Adoptive T Cell Therapy", J Cell Physiol; Dec. 2016;231(12):2590-8. doi: 10.1002/jcp.25419. Epub Jun. 2, 2016.

Grotzinger, Joachim, "Molecular mechanisms of cytokine receptor activation", Biochim Biophys Acta; Nov. 11, 2002;1592(3):215-23.

Hu, Yuan, et al., "Chimeric antigen receptor (CAR)-transduced natural killer cells in tumor immunotherapy", Acta Pharmacol Sin; Feb. 2018;39(2):167-176. doi: 10.1038/aps.2017.125. Epub Sep. 7, 2017.

Kim, Jin Hee, et al., "High cleavage efficiency of a 2A peptide derived from porcine teschovirus-1 in human cell lines, zebrafish and mice", PLoS One; 2011;6(4):e18556. doi: 10.1371/journal.pone. 0018556. Epub Apr. 29, 2011.

Shao, Huang, "Structural requirements for signal transducer and activator of transcription 3 binding to phosphotyrosine ligands containing the YXXQ motif", J Biol Chem; Apr. 30, 2004;279(18):18967-73. doi: 10.1074/jbc.M314037200. Epub Feb. 13, 2004.

Zhang, Cheng, et al., "Engineering CAR-T cells", Biomarker Research vol. 5, Article No. 22 (2017).

(56) References Cited

OTHER PUBLICATIONS

Behncken, Stuart N., et al., "Growth Hormone (GH)-independent Dimerization of GH Receptor by a Leucine Zipper Results in Constitutive Activation", Journal of Biological Chemistry; vol. 275 Issue 22 pp. 17000-17007 (Jun. 2000) DOI: 10.1074/jbc.275.22.17000.

Ding, Jiamin, et al., "Asn 505 Mutation of the C-MPL Gene, A Cause of Familial Essential Thrombocythemia, Induces the Autonomous Homodimerizaton of the C-Mpl Independent of Ligand Stimulation.", Blood; vol. 104, Issue 11, Nov. 16, 2004, p. 738.

Metcalfe, Riley D., et al., "Structural Understanding of Interleukin 6 Family Cytokine Signaling and Targeted Therapies: Focus on Interleukin 11", Front. Immunol., Jul. 16, 2020; Sec. Cytokines and Soluble Mediators in Immunity https://doi.org/10.3389/fimmu.2020.01424.

Shochat, Chen, et al., "Gain-of-function mutations in interleukin-7 receptor-α (IL7R) in childhood acute lymphoblastic leukemias", Journal of Experimental Medicine; 2(2011) 208 (5): 901-908; https://doi.org/10.1084/jem.20110580.

Suthaus, Jan, et al., "Forced Homo- and Heterodimerization of All gp130-Type Receptor Complexes Leads to Constitutive Ligand-independent Signaling and Cytokine-independent Growth", Molecular Biology of the Cellvol. 21, No. 15; 2797-2807; Aug. 1, 2010; https://doi.org/10.1091/mbc.e10-03-0240.

Xie, Jiasen, et al., "Construction of an anti-programmed death-ligand 1 chimeric antigen receptor and determination of its antitumor function with transduced cells", Oncology Letters; Jul. 2018; vol. 16 Issue 1; DOI: https://doi.org/10.3892/ol.2018.8617.

Zenatti, Priscila P., et al., "Oncogenic IL7R gain-of-function mutations in childhood T-cell acute lymphoblastic leukemia", Nature Genetics; Sep. 4, 2011;43(10):932-9. doi: 10.1038/ng.924.

Tim Clackson, et al.; "Redesigning an FKBP-ligand interface to generate chemical dimerizers with novel specificity", Proc. Natl. Acad. Sci. USA, vol. 95, Sep. 1998, pp. 10437-10442.

Moraga, I. et al. Tuning Cytokine Receptor Signaling by Re-orienting Dimer Geometry with Surrogate Ligands. Cell. 2015. vol. 160. No. 6. p. 1196-1208.

Shaposhnikov, A.V. et al., Molecular components of JAK/STAT signaling pathway and its connection with transcription machinery. Molecular Biology. 2013. vol. 47. N. 3. p. 388-397. (Russian language article with English language abstract).

Wang X. et al., Structural biology of shared cytokine receptors. Annu Rev Immunol. 2009. vol. 27. p. 29-60.

Zhang C. et al., Engineering CAR-T cells. Biomark Res., vol. 5, Issue No. 22, pp. 1-6 (Jun. 2017).†

Ajina A. et al., Strategies to Address Chimeric Antigen Receptor Tonic Signaling. Mol Cancer Ther., vol. 17, Issue No. 9, pp. 1795-1815 (Sep. 2018).†

Gacerez, A. T. et al., How chimeric antigen receptor design affects adoptive T cell therapy. J Cell Physiol., vol. 231, Issue No. 12, pp. 2590-2598 (Dec. 2016).†

Hu, Y. et al., Chimeric antigen receptor (CAR)-transduced natural killer cells in tumor immunotherapy. Acta Pharmacol Sin., vol. 39, Issue No. 2, pp. 167-176 (Feb. 2018).†

\* cited by examiner
† cited by third party

FIG. 21

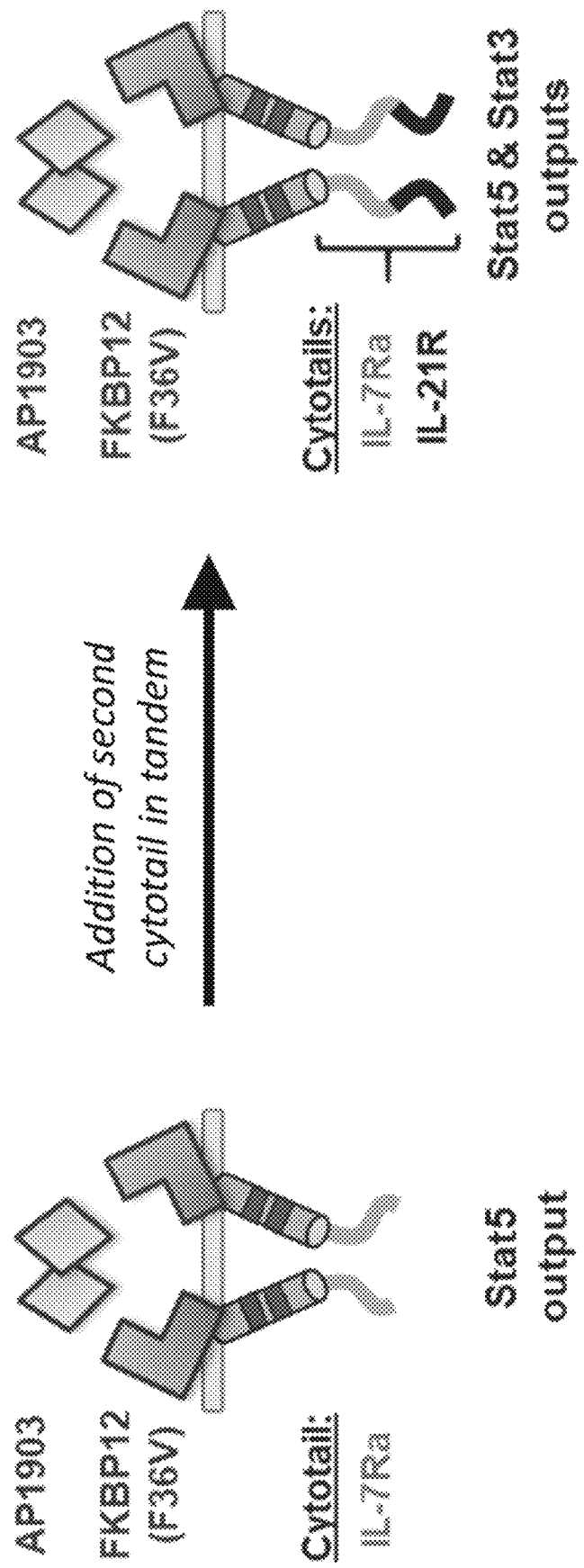

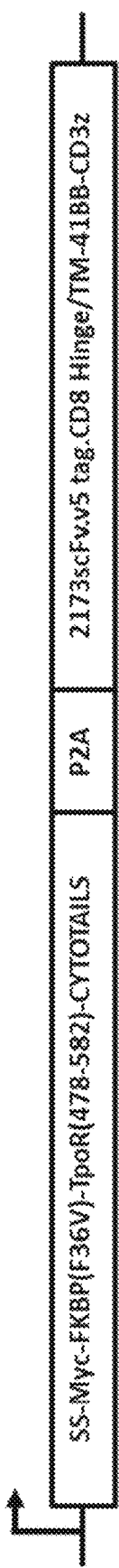
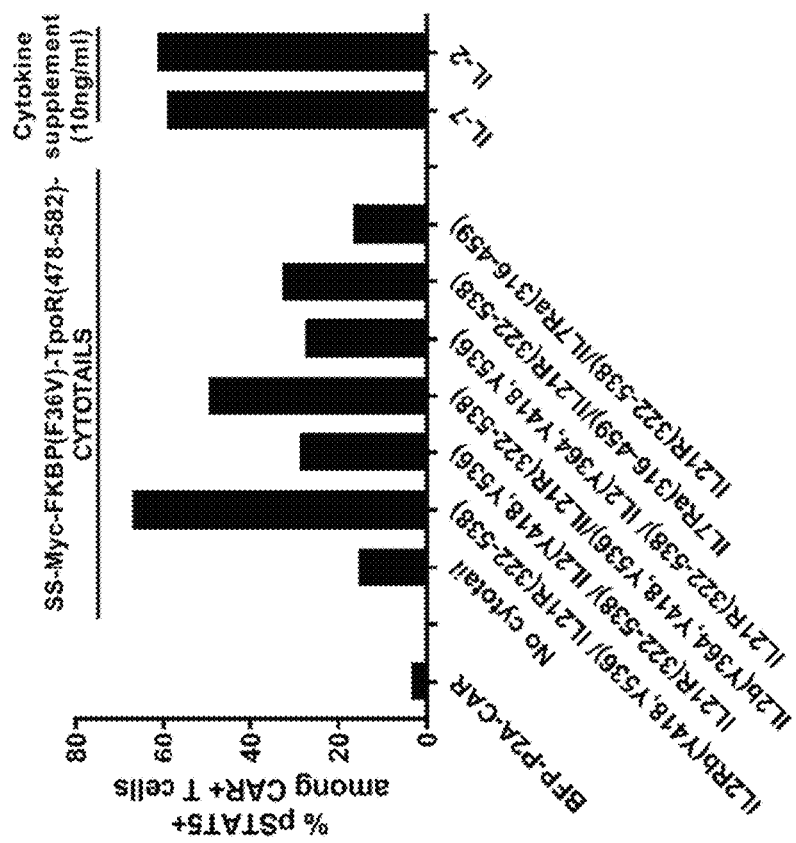
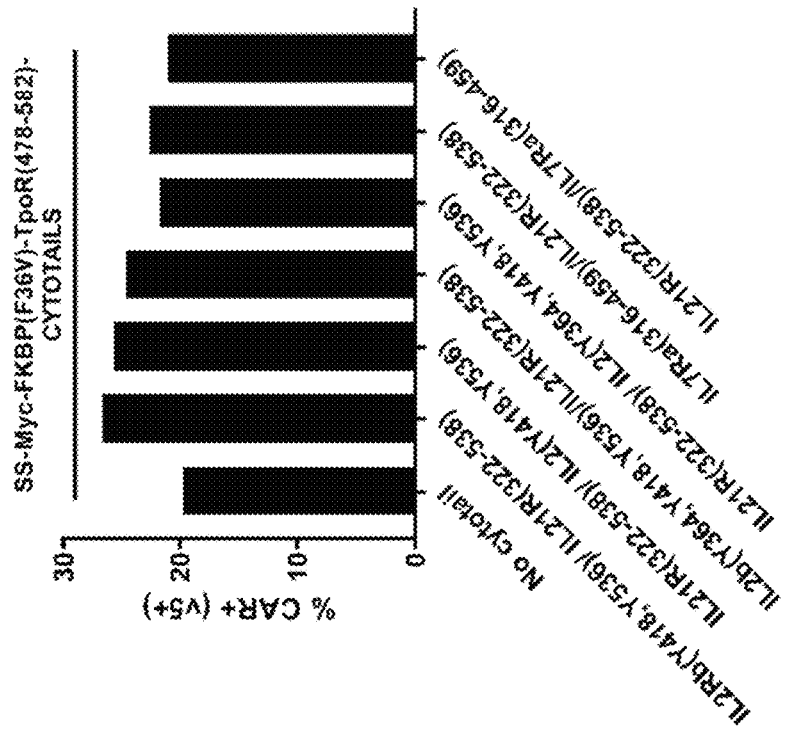

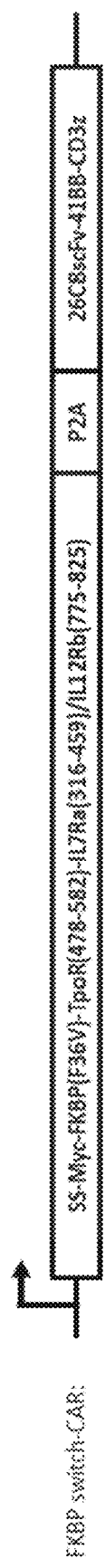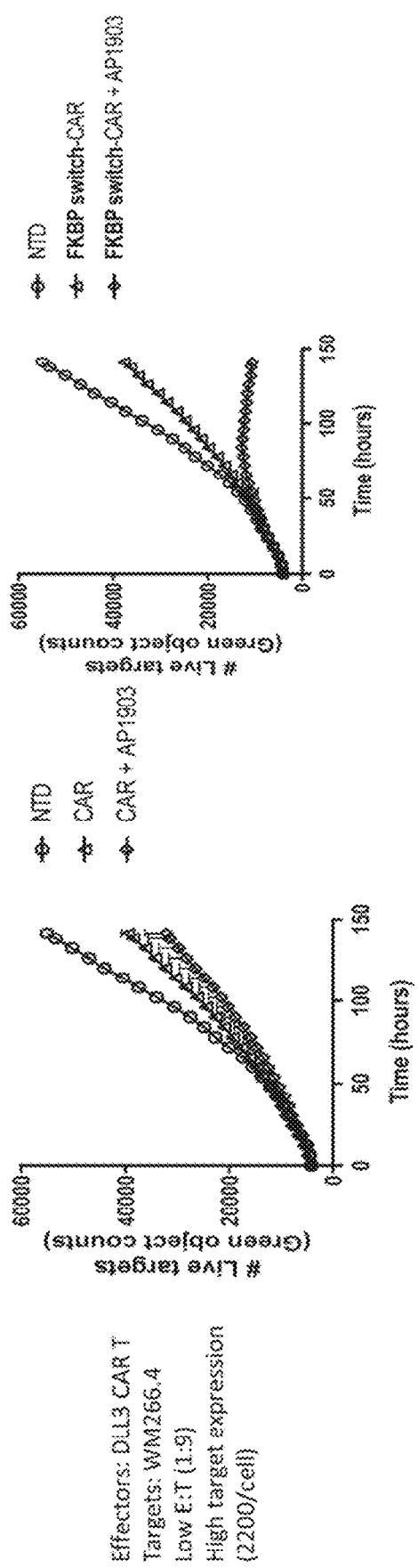
FIG. 30A
FIG. 30B
FIG. 30C

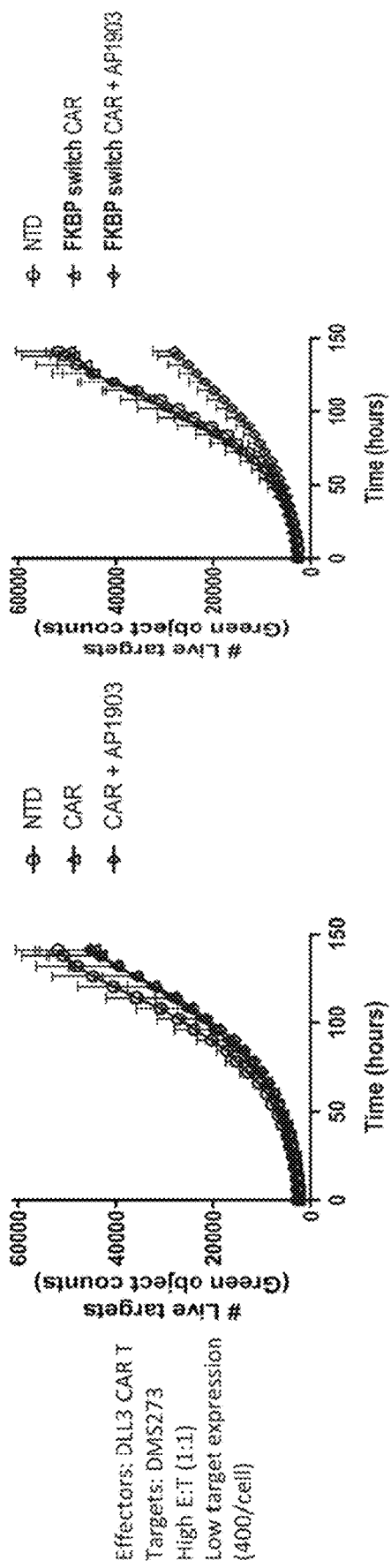

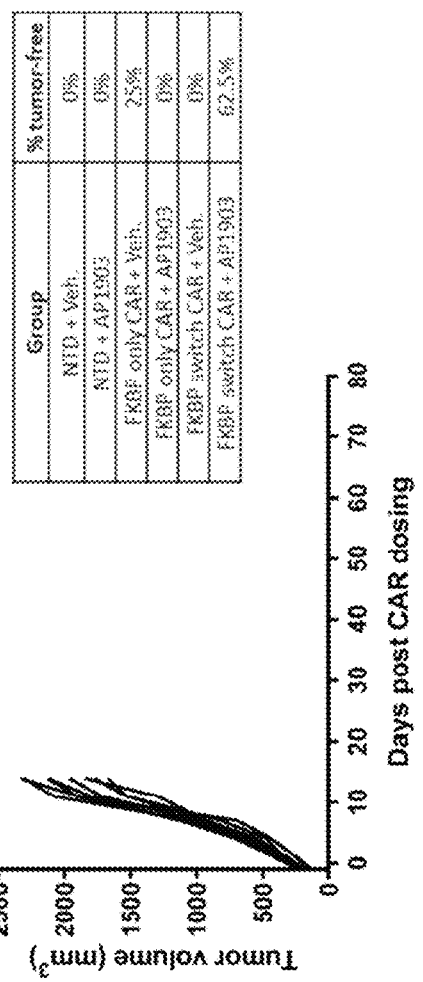
FIG. 31B NTD + Veh.
FIG. 31C NTD + AP1903
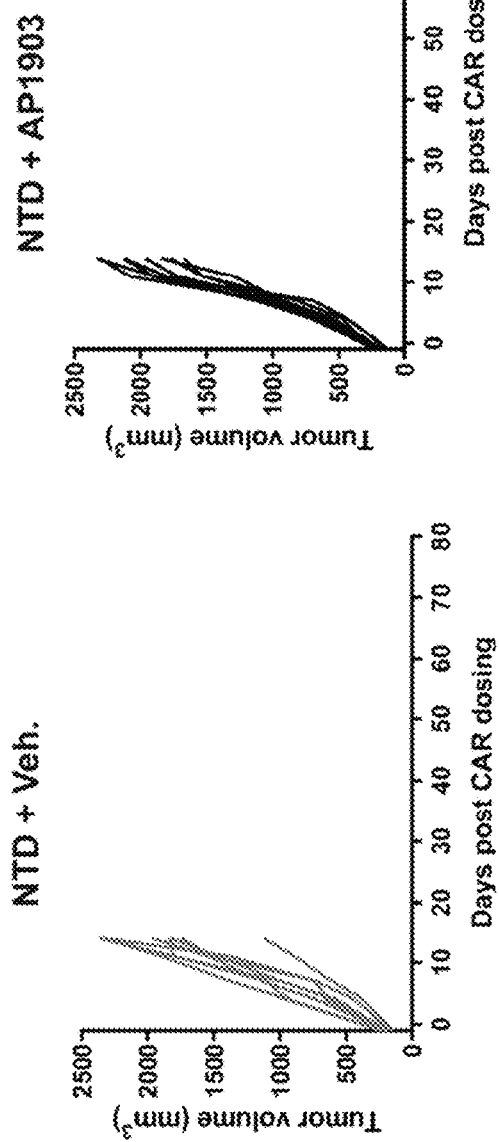
FIG. 31D FKBP only CAR + Veh.
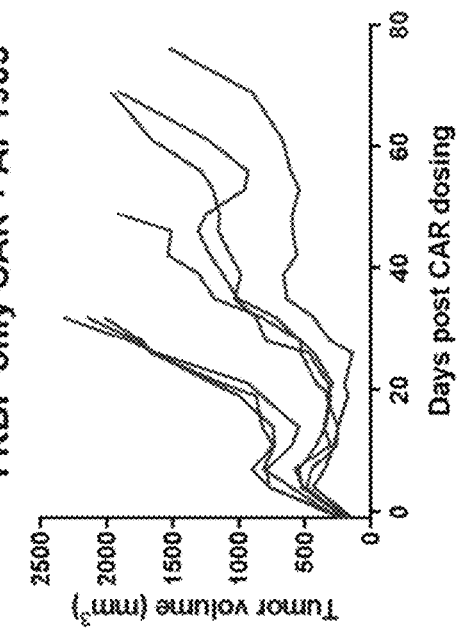
FIG. 31E FKBP only CAR + AP1903
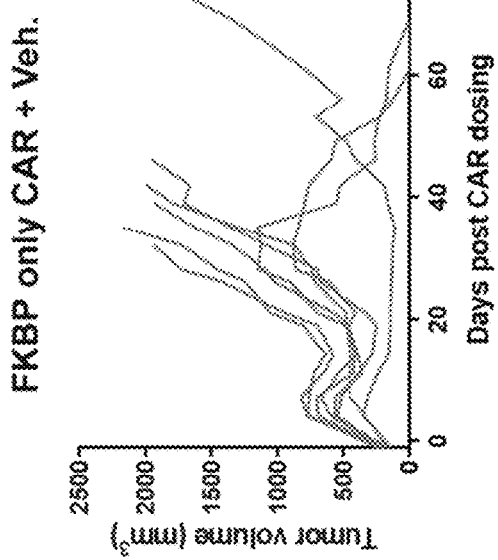

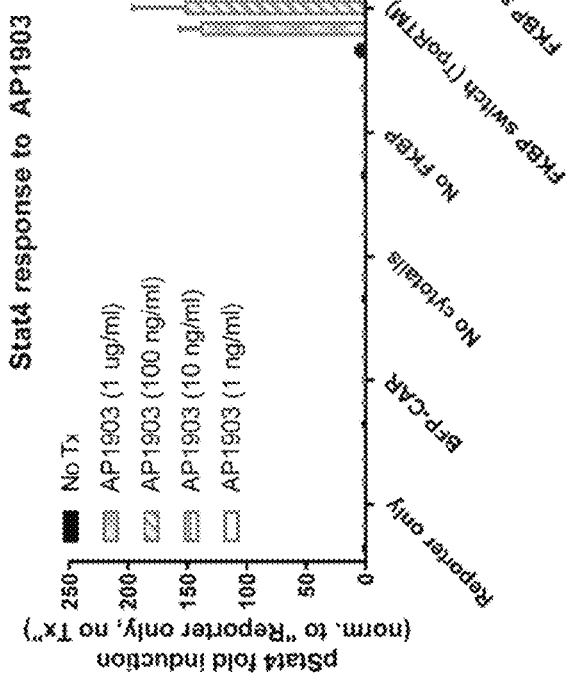
FIG. 33C
FIG. 33D
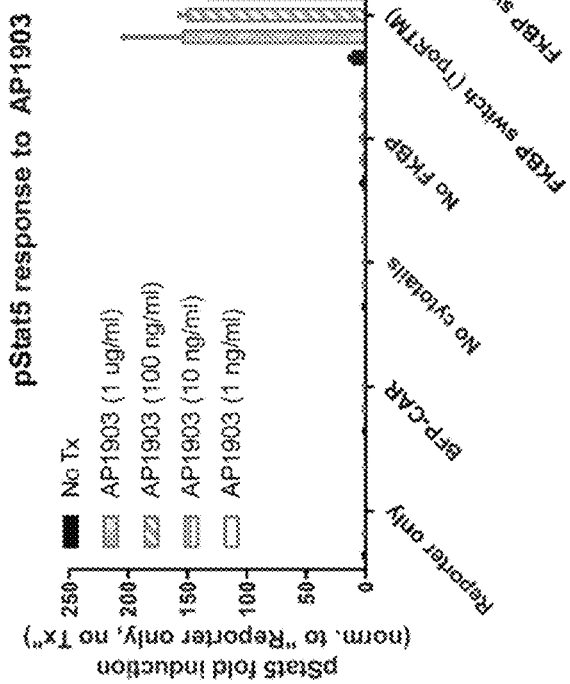

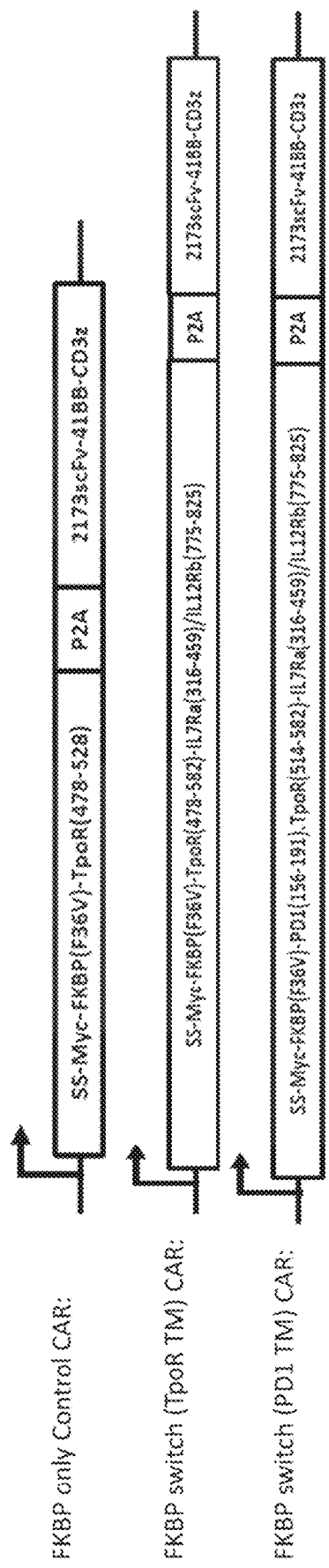

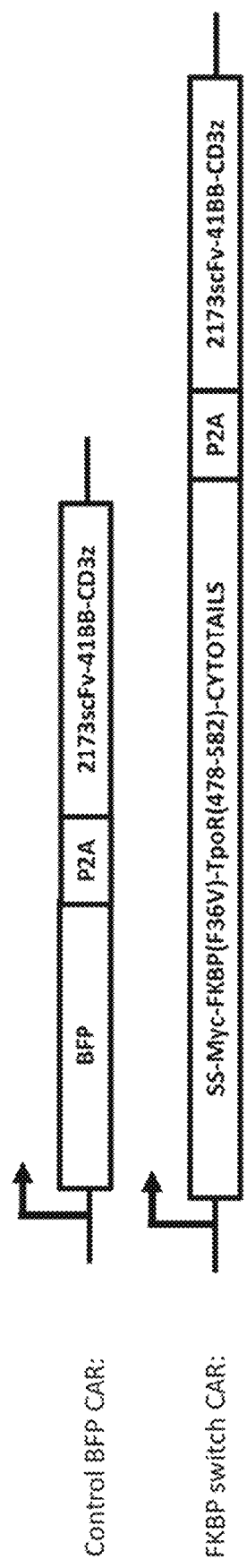
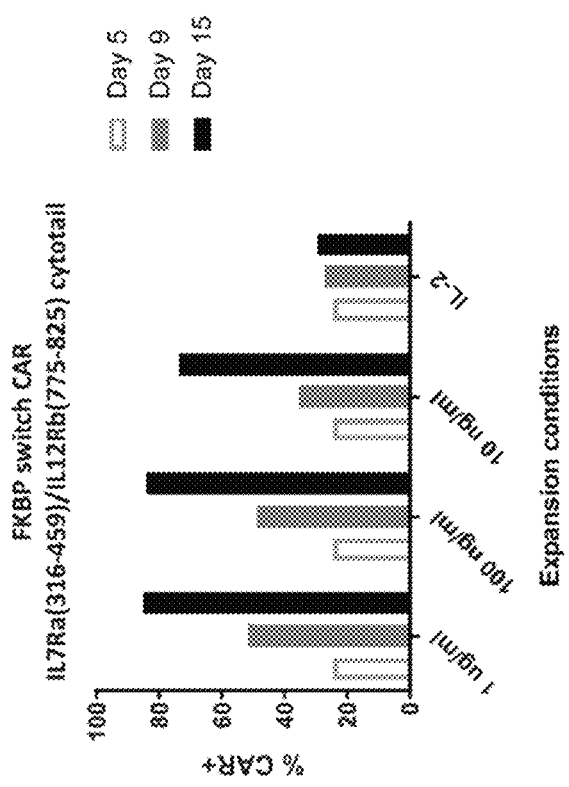
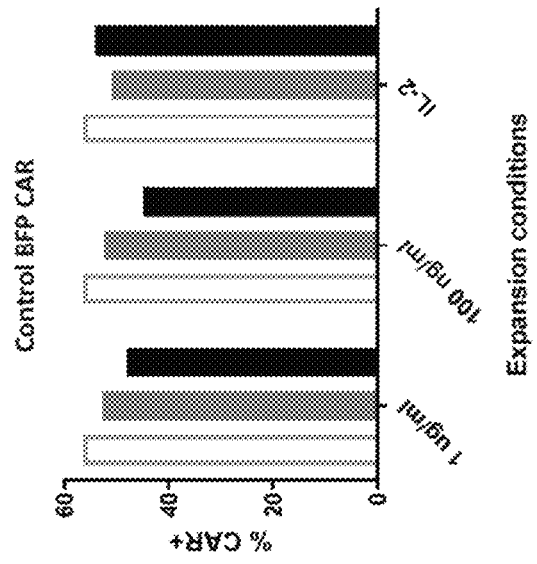
FIG. 35A
FIG. 35C
FIG. 35B

Underlined: wildtype TpoR TM region
Bold: means insertion

FIG. 38A

```
Template:  SDPTRVETATETAW ISLVTALHLVLGLSAVLGLILLLRWQFPAHYRRLRHALWPSL  (4138 - 4302 bp)
N-1:       SDPTRVETATETAW-WISLVTALHLVLGLSAVLGLILLLRWQFPAHYRRLRHALWPSL
N-2:       SDPTRVETATET---ISLVTALHLVLGLSAVLGLILLLRWQFPAHYRRLRHALWPSL
N-2+1:     SDPTRVETATET--LISLVTALHLVLGLSAVLGLILLLRWQFPAHYRRLRHALWPSL
N-3:       SDPTRVETATET----SLVTALHLVLGLSAVLGLILLLRWQFPAHYRRLRHALWPSL
N-4:       SDPTRVETATET-----LVTALHLVLGLSAVLGLILLLRWQFPAHYRRLRHALWPSL
N-4+1:     SDPTRVETATET----ILVTALHLVLGLSAVLGLILLLRWQFPAHYRRLRHALWPSL
N-5:       SDPTRVETATET------VTALHLVLGLSAVLGLILLLRWQFPAHYRRLRHALWPSL
N-6:       SDPTRVETATET-------TALHLVLGLSAVLGLILLLRWQFPAHYRRLRHALWPSL
N-7:       SDPTRVETATET--------ALHLVLGLSAVLGLILLLRWQFPAHYRRLRHALWPSL
N-8:       SDPTRVETATET---------LHLVLGLSAVLGLILLLRWQFPAHYRRLRHALWPSL
N-9:       SDPTRVETATET----------HLVLGLSAVLGLILLLRWQFPAHYRRLRHALWPSL
```

FIG. 38B

```
Template:  SDPTRVETATETAW---------------ISLVTALHLVLGLSAVLGLILLLRWQFPAHYRRLRHALWPSL  (4138 - 4302 bp)
N+1:       SDPTRVETATETAW--------------LISLVTALHLVLGLSAVLGLILLLRWQFPAHYRRLRHALWPSL
N+2:       SDPTRVETATETAW-------------VLISLVTALHLVLGLSAVLGLILLLRWQFPAHYRRLRHALWPSL
N+3:       SDPTRVETATETAW------------LVLISLVTALHLVLGLSAVLGLILLLRWQFPAHYRRLRHALWPSL
N+4:       SDPTRVETATETAW-----------ILVLISLVTALHLVLGLSAVLGLILLLRWQFPAHYRRLRHALWPSL
N+5:       SDPTRVETATETAW----------LILVLISLVTALHLVLGLSAVLGLILLLRWQFPAHYRRLRHALWPSL
N+6:       SDPTRVETATETAW---------LLILVLISLVTALHLVLGLSAVLGLILLLRWQFPAHYRRLRHALWPSL
N+7:       SDPTRVETATETAW--------VLLILVLISLVTALHLVLGLSAVLGLILLLRWQFPAHYRRLRHALWPSL
N+8:       SDPTRVETATETAWLVTLILVLISLVTALHLVLGLSAVLGLILLLRWQFPAHYRRLRHALWPSL
```

| Figure label | Sequence |
|---|---|
| Y449 | IL7R(423-459,Y456F) |
| IL7 | IL7R(316-459) |
| IL12S | IL12RbSmall(775-825) |
| EGFR | EGFR(1122-1165) |
| IL7-IL12 | IL7R(316-459)-IL12RbSmall(775-825) |
| IL7-EGFR | IL7R(316-459)-EGFR(1122-1165) |

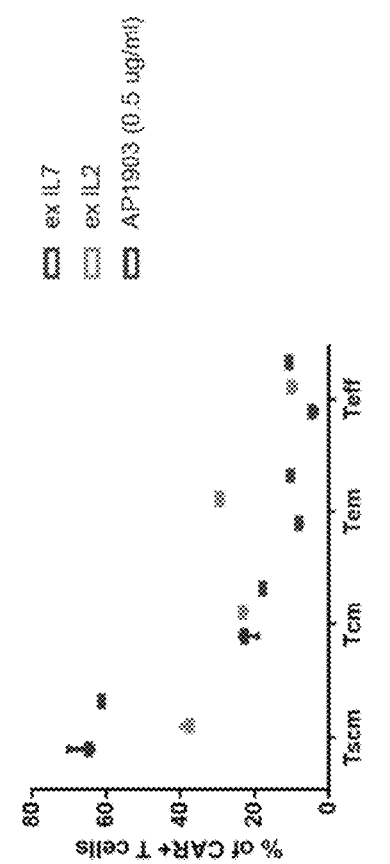
FIG. 44F
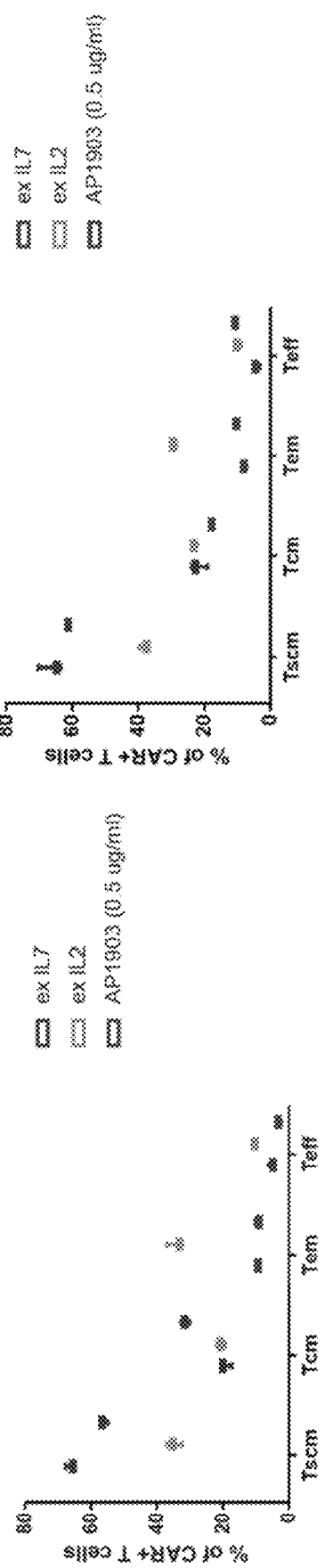
FIG. 44E
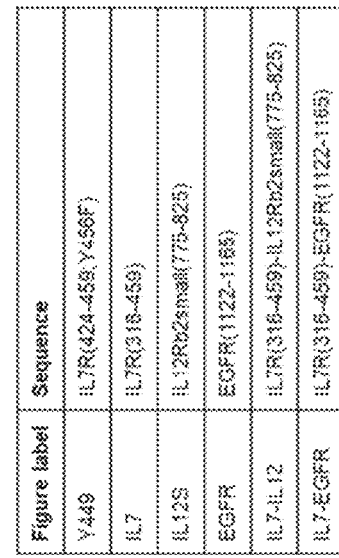
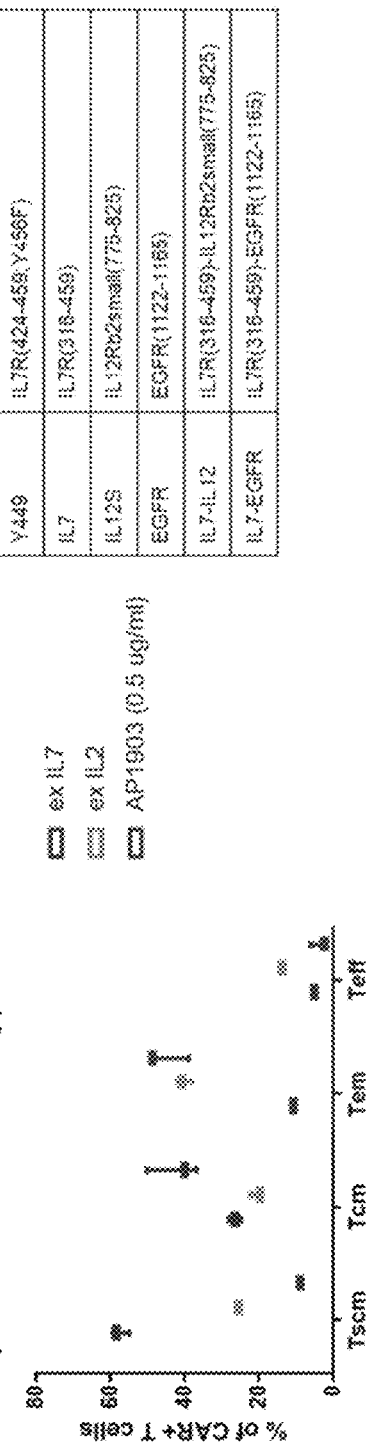
FIG. 44G

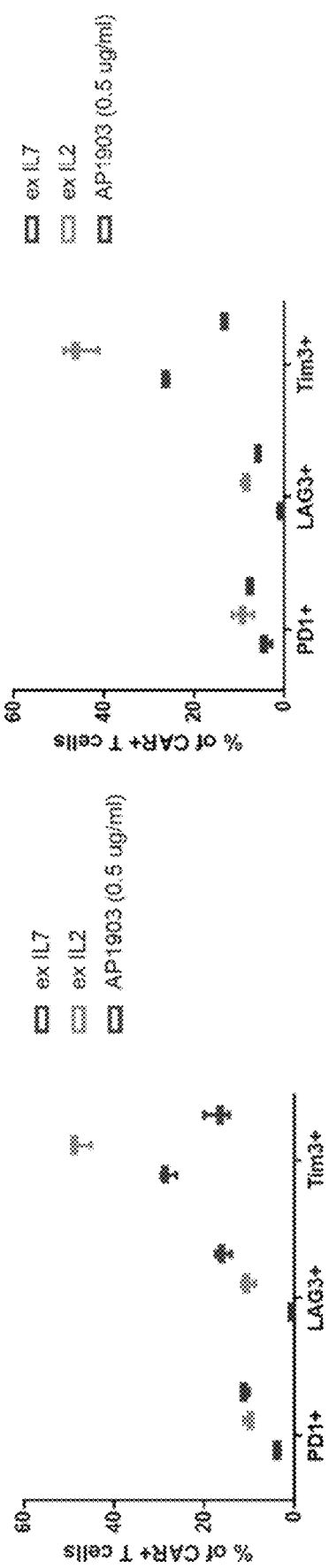
FIG. 45E
FIG. 45F
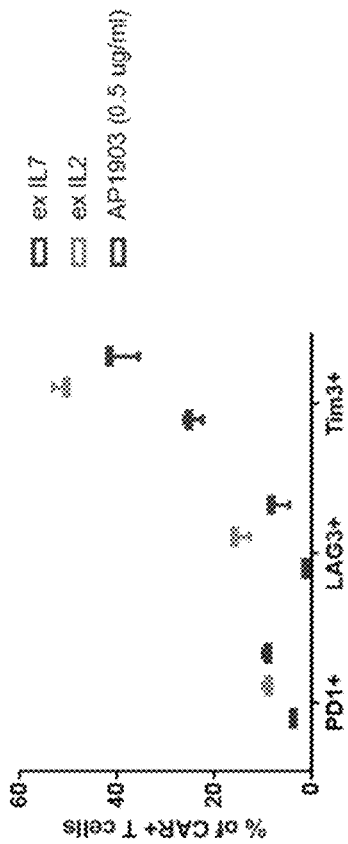
FIG. 45G ial activities of genetically modified T cells (e.g., gene-modified antigen-specific T cells, such as chimeric antigen receptor T (CAR-T) cells), cells comprising the inducible chimeric cytokine receptors, and compositions comprising such cells. In particular, the present invention provides methods and compositions for bolstering the therapeutic efficacy of CAR-T cells.
INDUCIBLE CHIMERIC CYTOKINE RECEPTORS

CROSS REFERENCE TO RELATED APPLICATIONS

The present application claims the benefit of priority to U.S. Provisional Application No. 62/637,600, filed on Mar. 2, 2018, the contents of which are hereby incorporated by reference in their entirety.

REFERENCE TO SEQUENCE LISTING

This application is being filed electronically via EFS-Web and includes an electronically submitted sequence listing in .txt format. The .txt file contains a sequence listing entitled ALGN-016 01US333466-2240 SL.txt created on Apr. 25, 2019, and having a size of 866,941 bytes. The sequence listing contained in this .txt file is part of the specification and is incorporated herein by reference in its entirety.

FIELD

The present invention relates generally to inducible chimeric cytokine receptors for use with immune cells (e.g., T cells) to treat disease.

BACKGROUND

Chimeric antigen receptor T (CAR-T) cells have entered the clinic and have demonstrated very promising results (Maus, M. et al., 2014, Blood 123, 2625-35). Although the majority of subjects have been treated with autologous CAR-T cells which are derived from the subject's own T cells, allogeneic CAR-T cells derived from healthy donors offers a more commercially viable off-the-shelf option with the potential to treat a broader range of subjects.

Allogeneic CAR-T cells are generated by endowing T cells from healthy donors with CARs that are specifically activated by tumor associated antigens. Allogeneic CAR-T cells that do not express functional TCR (e.g., via knockout or knockdown) are deficient in basal TCR signaling. Basal TCR signaling increases persistence. TCR mobilizes $Ca^{2+}$, eventually leading to NFAT and NFkB activation. Although cytokines can increase persistence through STAT5, this does not reproduce native TCR signaling. Thus, there is a need for compositions and methods to improve allogeneic CAR-T cell persistence.

SUMMARY

The present invention provides inducible chimeric cytokine receptors responsive to a ligand, e.g., a small molecule or protein, uses of such receptors for improving the functional activities of genetically modified T cells (e.g., gene-modified antigen-specific T cells, such as chimeric antigen receptor T (CAR-T) cells), cells comprising the inducible chimeric cytokine receptors, and compositions comprising such cells. In particular, the present invention provides methods and compositions for bolstering the therapeutic efficacy of CAR-T cells.

In one aspect, the invention provides an inducible chimeric cytokine receptor comprising: a dimerization domain; a tyrosine kinase activating domain; and a tyrosine effector domain.

In some embodiments, the tyrosine kinase activating domain comprises a Janus Kinase (JAK)-binding domain of, or derived from, a protein. In some of these embodiments, the tyrosine kinase activating domain further comprises a transmembrane domain.

In some embodiments, the tyrosine kinase activating domain comprises a tyrosine kinase domain of, or derived from, a receptor tyrosine kinase (RTK). In some of these embodiments, the tyrosine kinase activating domain further comprises a transmembrane domain.

In some embodiments, the tyrosine effector domain comprises a STAT-activation domain of, or derived from, at least one receptor. In some embodiments, the tyrosine effector domain comprises at least two STAT-activation domains of, or derived from, two receptors. In some embodiments, the tyrosine effector domain comprises STAT-activation domains of, or derived from, at least three, four, or more receptors.

In some embodiments, the tyrosine effector domain comprises a portion of the cytoplasmic tail of, or derived from, at least one receptor tyrosine kinase (RTK).

In some embodiments, the dimerization domain binds to a ligand such as AP1903, AP20187, dimeric FK506, or a dimeric FK506-like analog.

In some embodiments, the dimerization domain comprises an FKBP polypeptide. In some embodiments, the FKBP polypeptide is an FKBP12 polypeptide. In some embodiments, the FKBP12 polypeptide contains the amino acid substitution F36V (SEQ ID NO.: 218).

In some embodiments, the dimerization domain comprises an amino acid sequence selected from the group consisting of: (i) a FKBP polypeptide containing one or more amino acid substitutions, (ii) two or three tandem repeats of an unmodified FKBP polypeptide, and (iii) two or three tandem repeats of a FKBP polypeptide containing one or more amino acid substitutions.

In some embodiments, the dimerization domain comprises a dimerization domain sequence selected from SEQ ID NOs.: 69-87.

In some embodiments, the dimerization domain comprises an FKBP dimerization domain sequence selected from SEQ ID NOs.: 69-73.

In some embodiments, the dimerization domain comprises an amino acid sequence of, or derived from, a polypeptide selected from the group consisting of: FKBP12, FKBP12(F36V), an extracellular domain of OX-40, and an extracellular domain of a TNFR2 superfamily receptors. In exemplary embodiments, the TNFR2 superfamily receptor is BCMA, TACI, or BAFFR.

In some embodiments, the dimerization domain binds a small molecule. In exemplary embodiments, a small molecule is AP1903, AP20187, dimeric FK506, or a dimeric FK506-like analog. In some embodiments, the dimerization domain binds a protein.

In some embodiments, the dimerization domain comprises an amino acid sequence of, or derived from, a protein selected from the group consisting of: FKBP, cyclophilin, steroid binding protein, estrogen binding protein, glucocorticoid binding protein, vitamin D binding protein, tetracycline binding protein, extracellular domain of a cytokine receptor, receptor tyrosine kinase, TNFR-family receptor, and immune co-receptor.

In some embodiments, the immune co-receptor, from which the dimerization domain is derived from, is selected from the group consisting of: erythropoietin receptor, prolactin receptor, growth hormone receptor, thrombopoietin receptor, granulocyte colony-stimulating factor receptor, GP130, common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, TGFBR1/ALKL5, TGFBR2, EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, RTK106, TNFR1, Fas, TRAILR1, TRAILR2, NGFR, DR3, DR6, EDAR, TNFR2, LTbR, OX40, CD40, CD27, CD30, 4-1BB, RANK, Fn14, TACI, BAFFR, HVEM, BCMA, GITR, TROY, RELT, XEDAR, TRAILR3, TRAILR4, OPG, DcR3, PD-1, CD80, CD86, ICOS-L, ICOS, CTLA-4, BTLA, CD160, LAG3, and TIM3.

In some embodiments, the tyrosine kinase activating domain comprises a JAK-binding domain of, or derived from, a receptor. In an exemplary embodiment, the receptor is a hormone receptor.

In some embodiments, the tyrosine kinase activating domain comprises a JAK-binding domain of, or derived from, a protein or a receptor selected from the group consisting of EPOR, GP130, PRLR, GHR, GCSFR, and TPOR/MPLR.

In some embodiments, the tyrosine kinase activating domain comprises a tyrosine kinase domain of, or derived from, a RTK, wherein the RTK is selected from the group consisting of: EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, and RTK106. In an exemplary embodiment, the RTK is EGFR.

In some embodiments, the tyrosine kinase activating domain comprises a tyrosine kinase activating domain sequence selected from SEQ ID NOs.: 88-133.

In some embodiments, the transmembrane domain present in the tyrosine kinase activating domain comprises a transmembrane domain of, or derived from, a protein selected from the group consisting of: EPOR, GP130, PRLR, GHR, GCSFR, PD-1, and TPOR/MPLR.

In some embodiments, the transmembrane domain comprises a transmembrane domain derived from TPOR/MPLR. In some embodiments, the transmembrane domain is derived from amino acids 478-582 of the naturally occurring TPOR/MPLR sequence of SEQ ID NO.: 64.

In some embodiments, the transmembrane domain comprises a deletion variant of the amino acid region 478-582 of the naturally occurring TPOR/MPLR sequence of SEQ ID NO.: 64. In some embodiments, the deletion variant comprises a deletion of 1 to 18 amino acids from the region 478-582 of the naturally occurring TPOR/MPLR sequence of SEQ ID NO.: 64. In some embodiments, the deletion variant comprises a deletion of 1 to 18 amino acids from the region 489-510 of the naturally occurring TPOR/MPLR sequence of SEQ ID NO.: 64.

In some embodiments, the transmembrane domain comprises an insertion variant of the amino acid region 478-582 of the naturally occurring TPOR/MPLR sequence of SEQ ID NO.: 64. In some embodiments, the insertion variant comprises an insertion of 1 to 8 amino acids in the region 478-582 of the naturally occurring TPOR/MPLR sequence of SEQ ID NO.: 64. In some embodiments, the insertion variant comprises an insertion of 1 to 8 amino acids in the region 489-510 of the naturally occurring TPOR/MPLR sequence of SEQ ID NO.: 64. In exemplary embodiments, the amino acids inserted in the insertion variant are selected from the group consisting of: leucine, valine, and isoleucine.

In some embodiments, the tyrosine effector domain comprises at least one STAT-activation domain of, or derived from, a receptor. In some embodiments, the tyrosine effector domain comprises at least two STAT-activation domains of, or derived from, two receptors. In some embodiments, the tyrosine effector domain comprises STAT-activation domains of, or derived from, at least three, four, or more receptors. In some embodiments, the receptors are hormone receptors and/or cytokine receptors.

In some embodiments, the tyrosine effector domain comprises STAT-activation domains of, or derived from, at least one, two, three, four, or more receptors, wherein the receptors are selected from the group consisting of: BLNK, IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R.

In some embodiments, the tyrosine effector domain comprises a cytotail (a portion of the cytoplasmic tail of a receptor comprising one or more tyrosine residues that can be phosphorylated) of, or derived from, at least one, two, three, four, or more receptors, wherein the receptor is a cytokine receptor, hormone receptor, and/or a RTK.

In some embodiments, an inducible chimeric cytokine receptor comprises a dimerization domain; a tyrosine kinase activating domain comprising a transmembrane domain and a JAK-binding domain; and a tyrosine effector domain comprising at least one STAT-activation domain of, or derived from, a receptor. In some of these embodiments, the tyrosine effector domain may comprise STAT-activation domains of, or derived from, at least two, three, four, or more receptors.

In some embodiments, an inducible chimeric cytokine receptor comprises a dimerization domain; a tyrosine kinase activating domain comprising a transmembrane domain and a JAK-binding domain; and a tyrosine effector domain comprising at least one cytotail of, or derived from, a receptor. In some of these embodiments, the tyrosine effector domain may comprise cytotails of, or derived from, at least two, three, four, or more receptors.

In some embodiments, an inducible chimeric cytokine receptor comprises a dimerization domain comprising an FKBP polypeptide; a tyrosine kinase activating domain comprising a transmembrane domain and a JAK-binding domain, wherein the transmembrane domain comprises a transmembrane domain of, or derived from, a protein selected from the group consisting of: EPOR, GP130, PRLR, GHR, GCSFR, PD-1, and TPOR, and the JAK-binding domain comprises a JAK-binding domain of, or derived from, a protein selected from the group consisting of: EPOR, GP130, PRLR, GHR, GCSFR, and TPOR; and a tyrosine effector domain comprising at least one STAT-activation domain of, or derived from, a receptor selected from the group consisting of: BLNK, IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R. In some of these embodiments, the tyrosine effector domain comprises STAT-activation domains of, or derived from, at least two, three, four, or more receptors.

In some embodiments, the tyrosine effector domain comprises a tyrosine effector domain sequence selected from SEQ ID NOs.: 134-176.

In some embodiments, the dimerization domain is located at the N-terminus of the inducible chimeric cytokine receptor.

In some embodiments, the dimerization domain is located at the C-terminus of the inducible chimeric cytokine receptor.

In some embodiments, the inducible chimeric cytokine receptor provided herein comprises a membrane-targeting motif. In exemplary embodiments, the membrane-targeting motif comprises a myristoylation motif.

In some embodiments, the inducible chimeric cytokine receptor provided herein is myristoylated.

In some embodiments, the inducible chimeric cytokine receptor comprises a sequence disclosed in Tables 2A or 2B. In some embodiments, the inducible chimeric cytokine receptor comprises a sequence selected from SEQ ID NOs.: 1-58, 187-215, and 225-311.

In another aspect, the present disclosure provides polynucleotides comprising a nucleic acid sequence encoding the inducible chimeric cytokine receptors described herein. In another aspect, the present disclosure provides an expression vector comprising the polynucleotides.

In another aspect, the present disclosure provides an engineered immune cell comprising at least one inducible chimeric cytokine receptor disclosed herein. In some embodiments, the engineered immune cell comprises at least two inducible chimeric cytokine receptors. In some embodiments, the engineered immune cell comprises at least three or four inducible chimeric cytokine receptors disclosed herein. When more than one inducible chimeric cytokine receptor is present in the immune cells, the dimerization domain, the tyrosine kinase activating domain, and the tyrosine effector domain of each receptor can be the same or different.

In another aspect, the present disclosure provides an engineered immune cell comprising at least one polynucleotide encoding inducible chimeric cytokine receptor disclosed herein.

In some embodiments, the engineered immune cell further comprises a chimeric antigen receptor (CAR) or a polynucleotide encoding a CAR.

In some embodiments, the immune cell is selected from the group consisting of: T cell, dendritic cell, killer dendritic cell, mast cell, NK-cell, macrophage, monocyte, and B-cell.

In some embodiments, the immune cell is derived from a stem cell. In exemplary embodiments, the immune cell is derived from adult stem cells, non-human stem cells, cord blood stem cells, progenitor cells, bone marrow stem cells, induced pluripotent stem cells, totipotent stem cells or hematopoietic stem cells.

In some embodiments, the immune cell is a T cell. In some embodiments, the immune cell is an autologous T cell. In some embodiments, the immune cell is an allogeneic T cell.

In another aspect, the present disclosure provides a method of modulating an engineered immune cell in a subject, the method comprising administering a ligand to a subject that has previously been administered an engineered immune cell described herein, wherein the dimeric ligand binds to the dimerization domain of the inducible chimeric cytokine receptor. In an exemplary embodiment, the ligand is AP1903.

In another aspect, provided herein is a method of preparing an engineered immune cell, the method comprising introducing a polynucleotide or an expression vector comprising a polynucleotide encoding an inducible chimeric cytokine receptor into an immune cell. In an exemplary embodiment, the immune cell is selected from the group consisting of: T cell, dendritic cell, killer dendritic cell, mast cell, NK-cell, macrophage, monocyte, B-cell, and an immune cell derived from a stem cell. In an exemplary embodiment, the immune cell is a T cell.

In another aspect, the disclosure provides an isolated immune cell comprising: (i) at least one inducible chimeric cytokine receptor comprising a dimerization domain, a tyrosine kinase activating domain, and a tyrosine effector domain as disclosed herein; and (ii) a chimeric antigen receptor (CAR) comprising an extracellular ligand-binding domain, a transmembrane domain, and an intracellular signaling domain.

In some embodiments, the isolated immune cell comprises at least two inducible chimeric cytokine receptors. In some other embodiments, the isolated immune cell comprises three or four inducible chimeric cytokine receptors.

In some embodiments, the isolated immune cell of the present disclosure exhibits improved persistence upon contact with a ligand that binds to the dimerization domain relative to persistence of an isolated immune cell that does not express the inducible chimeric cytokine receptor.

In some embodiments, the isolated immune cell of the present disclosure exhibits increased activation of STAT upon contact with a ligand that binds to the dimerization domain relative to activation of STAT shown by an isolated immune cell that does not express the inducible chimeric cytokine receptor. The STAT activated in the cell can be STAT1, STAT2, STAT3, STAT4, STAT5, STAT6, or combinations thereof.

In some embodiments, the activation of STAT by the isolated immune cell of the present disclosure, upon contact with a ligand that binds to the dimerization domain, increases with the dose of the ligand compared to activation of STAT shown by the isolated immune cell that does not express the inducible chimeric cytokine receptor.

In some embodiments, the isolated immune cell of the present disclosure exhibits increased cytotoxicity upon contact with a ligand that binds to the dimerization domain compared to cytotoxicity exhibited by an isolated immune cell that does not express the inducible chimeric cytokine receptor.

In some embodiments, the isolated immune cell of the present disclosure expands (proliferates) upon contact with a ligand that binds to the dimerization domain compared to an isolated immune cell that does not express the inducible chimeric cytokine receptor.

In some embodiments, the level of cell markers for stem cell memory (Tscm) and/or central memory (Tcm) on the isolated immune cell of the present disclosure are increased or maintained upon contact with a ligand that binds to the dimerization domain compared to the level of these markers on an isolated immune cell that does not express the inducible chimeric cytokine receptor.

In one aspect, provided herein is a method of generating an isolated immune cell comprising an inducible chimeric cytokine receptor disclosed herein, the method comprising the steps of: (a) providing an immune cell; (b) introducing into the immune cell a polynucleotide that encodes a chimeric antigen receptor (CAR) comprising an extracellular ligand-binding domain, a transmembrane domain, and an intracellular signaling domain; and (c) introducing into the immune cell a polynucleotide that encodes the inducible chimeric cytokine receptor.

In some embodiments, step c) of the above method comprises stably expressing the inducible chimeric cytokine receptor into the cell.

In some embodiments, in step c) of the above method, the polynucleotide that encodes the inducible chimeric cytokine receptor is introduced into the cell by a transposon/transposase system, a viral-based gene transfer system, or electroporation.

In some embodiments, in step b) of the above method, the polynucleotide that encodes the chimeric antigen receptor is introduced into the cell by a transposon/transposase system or a viral-based gene transfer system.

In some embodiments, the viral-based gene transfer system comprises recombinant retrovirus or lentivirus.

In some embodiments of the above method, step (b) occurs prior to step (c) or step (c) occurs prior to step (b).

In one aspect, the present disclosure provides a pharmaceutical composition comprising the isolated immune cell described herein.

In one aspect, the present disclosure provides a method for treating a disorder in a subject, wherein the method comprises administering the isolated immune cell comprising an inducible cytokine receptor disclosed herein or administering the pharmaceutical composition comprising such immune cells.

In another aspect, the present disclosure provides use of the isolated immune cell disclosed herein or a pharmaceutical composition comprising the isolated immune cell for treating a disorder.

In some embodiments, the cells or the pharmaceutical composition are provided to the subject more than once.

In some embodiments, the cells or the pharmaceutical composition are provided to the subject at least about 1, 2, 3, 4, 5, 6, 7, or more days apart In some embodiments, the subject has been previously treated with a therapeutic agent prior to administration of the isolated immune cell or the pharmaceutical composition. In an exemplary embodiment, the therapeutic agent is an antibody or chemotherapeutic agent.

In some embodiments, the disorder treated using the methods of the present disclosure is a viral disease, a bacterial disease, a cancer, an inflammatory disease, an immune disease, or an aging-associated disease. The cancer can be a hematological malignancy or a solid cancer.

In some embodiments, the hematological malignancy treated using the present methods is selected from acute lymphoblastic leukemia (ALL), acute myeloid leukemia (AML), chronic myelogenous leukemia (CML), chronic eosinophilic leukemia (CEL), myelodysplasia syndrome (MDS), non-Hodgkin's lymphoma (NHL), or multiple myeloma (MM).

In some embodiments, the solid cancer treated using the present methods is selected from biliary cancer, bladder cancer, bone and soft tissue carcinoma, brain tumor, breast cancer, cervical cancer, colon cancer, colorectal adenocarcinoma, colorectal cancer, desmoid tumor, embryonal cancer, endometrial cancer, esophageal cancer, gastric cancer, gastric adenocarcinoma, glioblastoma multiforme, gynecological tumor, head and neck squamous cell carcinoma, hepatic cancer, lung cancer, malignant melanoma, osteosarcoma, ovarian cancer, pancreatic cancer, pancreatic ductal adenocarcinoma, primary astrocytic tumor, primary thyroid cancer, prostate cancer, renal cancer, renal cell carcinoma, rhabdomyosarcoma, skin cancer, soft tissue sarcoma, testicular germ-cell tumor, urothelial cancer, uterine sarcoma, or uterine cancer.

BRIEF DESCRIPTION OF THE DRAWINGS

FIG. 12 discloses SEQ ID NOS 312-313, respectively, in order of appearance.

FIG. 21 depicts a graph summarizing the effects of the indicated inducible chimeric cytokine receptors on cytokine release.

FIG. 26 depicts a schematic of exemplary inducible cytokine receptors with dual tyrosine effector domains.

FIG. 28A depicts a schematic of an exemplary construct comprising a CAR and an inducible cytokine receptor.

FIG. 28B shows transduction efficiencies of T cells transduced with a vector comprising the construct shown in FIG. 28A.

FIG. 28C depicts a graph summarizing results of a FACS analysis testing function of the indicated inducible chimeric cytokine receptors.

FIG. 30A depicts a schematic of an exemplary construct comprising a CAR and an inducible cytokine receptor.

FIG. 30B depicts a graph summarizing results of an in vitro assay testing cytotoxicity of the indicated CAR-T cells.

FIG. 30C depicts a graph summarizing results of an in vitro assay testing cytotoxicity of the indicated CAR-T cells.

FIG. 30D depicts a graph summarizing results of an in vitro assay testing cytotoxicity of the indicated CAR-T cells.

FIG. 30E depicts a graph summarizing results of an in vitro assay testing cytotoxicity of the indicated CAR-T cells.

FIG. 31B depicts a graph summarizing results of a tumor volume assay for the indicated treatment group.

FIG. 31C depicts a graph summarizing results of a tumor volume assay for the indicated treatment group.

FIG. 31D depicts a graph summarizing results of a tumor volume assay for the indicated treatment group.

FIG. 31E depicts a graph summarizing results of a tumor volume assay for the indicated treatment group.

FIG. 33C depicts a graph summarizing results of a cell-based reporter assay testing function of the indicated inducible chimeric cytokine receptors.

FIG. 33D depicts a graph summarizing results of a cell-based reporter assay testing function of the indicated inducible chimeric cytokine receptors.

FIG. 34 A depicts a schematic of exemplary constructs comprising a CAR and an inducible cytokine receptor.

FIG. 35A depicts a schematic of exemplary constructs comprising a CAR and an inducible chimeric cytokine receptor.

FIG. 35B depicts a graph showing expansion of control CAR-T cells comprising the indicated inducible chimeric cytokine receptors.

FIG. 35C depicts a graph showing expansion of CAR-T cells comprising the indicated inducible chimeric cytokine receptors.

FIG. 38A shows the amino acid sequences for the wild-type TpoR and various transmembrane deletion variants (SEQ ID NOS 314-325, respectively, in order of appearance).

FIG. 38B shows the amino acid sequences for the wild-type TpoR and various transmembrane insertion variants (SEQ ID NOS 326-334, respectively, in order of appearance)

FIG. 44E depicts a graph summarizing the memory subset distribution of CAR-T cells comprising the indicated chimeric cytokine receptor.

FIG. 44F depicts a graph summarizing the memory subset distribution of CAR-T cells comprising the indicated chimeric cytokine receptor.

FIG. 44G depicts a graph summarizing the memory subset distribution of CAR-T cells comprising the indicated chimeric cytokine receptor.

FIG. 45E depicts a graph summarizing the effect of the indicated inducible chimeric cytokine receptor on cell phenotype.

FIG. 45F depicts a graph summarizing the effect of the indicated inducible chimeric cytokine receptor on cell phenotype.

FIG. 45G depicts a graph summarizing the effect of the indicated inducible chimeric cytokine receptor on cell phenotype.

DETAILED DESCRIPTION

Figure 1:
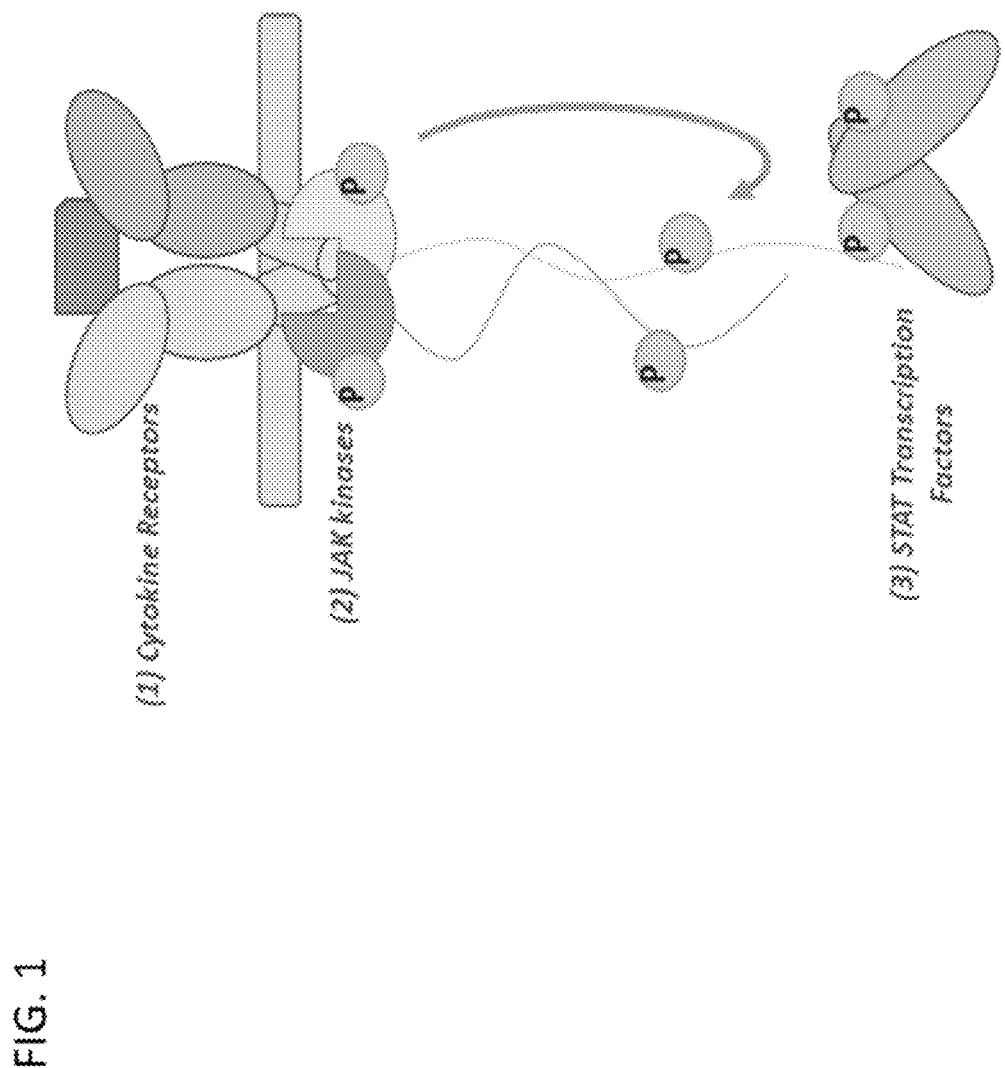
FIG. 1 depicts a schematic diagram of an exemplary inducible chimeric cytokine receptor.

The present invention provides chimeric receptors and uses thereof for improving in vivo persistence and therapeutic efficacy of immune cells. Receptors responsive to a ligand, such as a small molecule (e.g., AP1903) or protein (e.g., Epo, Tpo, or PD-L1) are provided herein. Also provided are cells comprising such inducible chimeric cytokine receptors, compositions comprising such cells, and methods for improving the functional activities of isolated T cells, such as CAR-T cells. Also provided herein are CAR-T cells having improved persistence, and methods of using such CAR-T cells for treating a disorder.

General Techniques

The practice of the invention will employ, unless otherwise indicated, conventional techniques of molecular biology (including recombinant techniques), microbiology, cell biology, biochemistry and immunology, which are within the skill of the art. Such techniques are explained fully in the literature, such as, Molecular Cloning: A Laboratory Manual, second edition (Sambrook et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-1998) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel et al., eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995).

Definitions

As used herein "autologous" means that cells, a cell line, or population of cells used for treating subjects are originating from said subject or from a Human Leucocyte Antigen (HLA) compatible donor.

As used herein "allogeneic" means that cells or population of cells used for treating subjects are not originating from said subject but from a donor.

As used herein, the term "endogenous" refers to any material from or produced inside an organism, cell, tissue or system.

As used herein, the term "exogenous" refers to any material introduced from or produced outside an organism, cell, tissue or system.

As used herein, "immune cell" refers to a cell of hematopoietic origin functionally involved in the initiation and/or execution of innate and/or adaptative immune response. Examples of immune cells include T cells, e.g., alpha/beta T cells and gamma/delta T cells, B cells, natural killer (NK) cells, natural killer T (NKT) cells, invariant NKT cells, mast cells, myeloic-derived phagocytes, dendritic cells, killer dendritic cells, macrophages, and monocytes. The term "immune cell" as used herein also refers to cells derived from, for example without limitation, a stem cell. The stem cells can be adult stem cells, non-human embryonic stem cells, more particularly non-human stem cells, cord blood stem cells, progenitor cells, bone marrow stem cells, induced pluripotent stem cells, totipotent stem cells or hematopoietic stem cells.

The terms "polypeptide", "oligopeptide", "peptide" and "protein" are used interchangeably herein to refer to chains of amino acids of any length, preferably, relatively short chains (e.g., 10-100 amino acids) as well as longer chains containing about 10-250, 10-500, 10-1000, 50-200, 50-500, or 50-1000 amino acids. The chain may be linear or branched, it may comprise modified amino acids, and/or may be interrupted by non-amino acids. The terms also encompass an amino acid chain that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that the polypeptides can occur as single chains or associated chains.

As used herein, the term "expression" refers to the transcription and/or translation of a particular nucleotide sequence driven by a promoter.

As used herein, "expression vector" refers to a vector comprising a recombinant polynucleotide comprising expression control sequences operatively linked to a nucleotide sequence to be expressed. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

As used herein, "operably linked" refers to the association of nucleic acid sequences on a single nucleic acid fragment so that the function of one is affected by the other. For example, a promoter is operably linked with a coding sequence when it is capable of affecting the expression of that coding sequence (i.e., that the coding sequence is under the transcriptional control of the promoter).

As used herein, "expression control sequence" means a nucleic acid sequence that directs transcription of a nucleic acid. An expression control sequence can be a promoter, such as a constitutive or an inducible promoter, or an enhancer. The expression control sequence is operably linked to the nucleic acid sequence to be transcribed.

"Promoter" and "promoter sequence" are used interchangeably and refer to a DNA sequence capable of controlling the expression of a coding sequence or functional RNA. In general, a coding sequence is located 3' to a promoter sequence. It is understood by those skilled in the art that different promoters may direct the expression of a gene in different tissues or cell types, or at different stages of development, or in response to different environmental or physiological conditions.

In any of the vectors of the present invention, the vector optionally comprises a promoter disclosed herein.

A "host cell" includes an individual cell or cell culture that can be or has been a recipient for vector(s) for incorporation of polynucleotide inserts. Host cells include progeny of a single host cell, and the progeny may not necessarily be completely identical (in morphology or in genomic DNA complement) to the original parent cell due to natural, accidental, or deliberate mutation. A host cell includes cells transfected in vivo with a polynucleotide(s) of this invention.

The term "extracellular ligand-binding domain" as used herein refers to an oligo- or polypeptide that is capable of binding a ligand. Preferably, the domain will be capable of interacting with a cell surface molecule. For example, the extracellular ligand-binding domain may be chosen to recognize a ligand that acts as a cell surface marker on target cells associated with a particular disease state.

The term "stalk domain" or "hinge domain" are used interchangeably herein to refer to any oligo- or polypeptide that functions to link the transmembrane domain to the extracellular ligand-binding domain. In particular, stalk domains are used to provide more flexibility and accessibility for the extracellular ligand-binding domain.

The term "intracellular signaling domain" refers to the portion of a protein which transduces the effector signal function signal and directs the cell to perform a specialized function.

A "co-stimulatory molecule" as used herein refers to the cognate binding partner on a T cell that specifically binds with a co-stimulatory ligand, thereby mediating a co-stimulatory response by the cell, such as, but not limited to proliferation. Co-stimulatory molecules include, but are not limited to an MHC class I molecule, BTLA and Toll ligand receptor. Examples of costimulatory molecules include CD27, CD28, CD8, 4-1BB (CD137), OX40, CD30, CD40, PD-1, ICOS, lymphocyte function-associated antigen-1 (LFA-1), CD2, CD7, LIGHT, NKG2C, B7-H3 and a ligand that specifically binds with CD83 and the like.

A "co-stimulatory ligand" refers to a molecule on an antigen presenting cell that specifically binds a cognate co-stimulatory signal molecule on a T cell, thereby providing a signal which, in addition to the primary signal provided by, for instance, binding of a TCR/CD3 complex with an MHC molecule loaded with peptide, mediates a T cell response, including, but not limited to, proliferation activation, differentiation and the like. A co-stimulatory ligand can include but is not limited to CD7, B7-1 (CD80), B7-2 (CD86), PD-L1, PD-L2, 4-1BBL, OX40L, inducible costimulatory ligand (ICOS-L), intercellular adhesion molecule (ICAM, CD30L, CD40, CD70, CD83, HLA-G, MICA, M1CB, HVEM, lymphotoxin 13 receptor, 3/TR6, ILT3, ILT4, an agonist or antibody that binds Toll ligand receptor and a ligand that specifically binds with B7-H3. A co-stimulatory ligand also encompasses, inter alia, an antibody that specifically binds with a co-stimulatory molecule present on a T cell, such as but not limited to, CD27, CD28, 4-1BB, OX40, CD30, CD40, PD-1, ICOS, lymphocyte function-associated antigen-1 (LFA-1), CD2, CD7, LTGHT, NKG2C, B7-H3, a ligand that specifically binds with CD83.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term encompasses not only intact polyclonal or monoclonal antibodies, but also antigen-binding fragments thereof (such as Fab, Fab', F(ab')2, and Fv), and any other modified configuration of the immunoglobulin molecule that comprises an antigen recognition site including, for example without limitation, single chain (scFv) and domain antibodies (including, for example, shark and camelid antibodies), and fusion proteins comprising an antibody, antibody mimetic or any protein that provides specific protein-protein interaction.

The term "antigen-binding fragment" or "antigen binding portion" of an antibody, as used herein, refers to one or more fragments of an intact antibody that retain the ability to specifically bind to a given antigen. Antigen binding functions of an antibody can be performed by fragments of an intact antibody. Examples of binding fragments encompassed within the term "antigen binding fragment" of an antibody include Fab; Fab'; F(ab')2; an Fd fragment consisting of the VH and CH1 domains; an Fv fragment consisting of the VL and VH domains of a single arm of an antibody; a single domain antibody (dAb) fragment (Ward et al., Nature 341:544-546, 1989), and an isolated complementarity determining region (CDR).

An antibody, an antibody conjugate, or a polypeptide that "preferentially binds" or "specifically binds" (used interchangeably herein) to a target (e.g., BCMA protein) is a term well understood in the art, and methods to determine such specific or preferential binding are also well known in the art. A molecule is said to exhibit "specific binding" or "preferential binding" if it reacts or associates more frequently, more rapidly, with greater duration and/or with greater affinity with a particular cell or substance than it does with alternative cells or substances. An antibody "specifically binds" or "preferentially binds" to a target if it binds with greater affinity, avidity, more readily, and/or with greater duration than it binds to other substances. It is also understood that by reading this definition, for example, an antibody (or moiety or epitope) that specifically or preferentially binds to a first target may or may not specifically or preferentially bind to a second target. As such, "specific binding" or "preferential binding" does not necessarily require (although it can include) exclusive binding. Generally, but not necessarily, reference to binding means preferential binding.

As known in the art, "polynucleotide," or "nucleic acid," as used interchangeably herein, refer to chains of nucleotides of any length, and include DNA and RNA. The nucleotides can be deoxyribonucleotides, ribonucleotides, modified nucleotides or bases, and/or their analogs, or any substrate that can be incorporated into a chain by DNA or RNA polymerase. A polynucleotide may comprise modified nucleotides, such as methylated nucleotides and their analogs. If present, modification to the nucleotide structure may be imparted before or after assembly of the chain. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha- or beta-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

As used herein, "transfection" refers to the uptake of exogenous or heterologous RNA or DNA by a cell. A cell has been "transfected" by exogenous or heterologous RNA or DNA when such RNA or DNA has been introduced inside the cell. A cell has been "transformed" by exogenous or heterologous RNA or DNA when the transfected RNA or DNA effects a phenotypic change. The transforming RNA or DNA can be integrated (covalently linked) into chromosomal DNA making up the genome of the cell.

As used herein, "transformation" refers to the transfer of a nucleic acid fragment into the genome of a host organism, resulting in genetically stable inheritance. Host organisms containing the transformed nucleic acid fragments are referred to as "transgenic" or "recombinant" or "transformed" organisms.

As used herein, "substantially pure" refers to material which is at least 50% pure (i.e., free from contaminants), more preferably, at least 90% pure, more preferably, at least 95% pure, yet more preferably, at least 98% pure, and most preferably, at least 99% pure.

As used herein, "treatment" is an approach for obtaining beneficial or desired clinical results. For purposes of this invention, beneficial or desired clinical results include, but are not limited to, one or more of the following: reducing the proliferation of (or destroying) neoplastic or cancerous cells, inhibiting metastasis of neoplastic cells, shrinking or decreasing the size of tumor, remission of a disease (e.g., cancer), decreasing symptoms resulting from a disease (e.g., cancer), increasing the quality of life of those suffering from a disease (e.g., cancer), decreasing the dose of other medications required to treat a disease (e.g., cancer), delaying the progression of a disease (e.g., cancer), curing a disease (e.g., cancer), and/or prolong survival of subjects having a disease (e.g., cancer).

"Ameliorating" means a lessening or improvement of one or more symptoms as compared to not administering a treatment. "Ameliorating" also includes shortening or reduction in duration of a symptom.

As used herein, an "effective dosage" or "effective amount" of drug, compound, or pharmaceutical composition is an amount sufficient to effect any one or more beneficial or desired results. For prophylactic use, beneficial or desired results include eliminating or reducing the risk, lessening the severity, or delaying the onset of the disease, including biochemical, histological and/or behavioral symptoms of the disease, its complications and intermediate pathological phenotypes presenting during development of the disease. For therapeutic use, beneficial or desired results include clinical results such as reducing incidence or amelioration of one or more symptoms of various diseases or conditions (such as for example cancer), decreasing the dose of other medications required to treat the disease, enhancing the effect of another medication, and/or delaying the progression of the disease. An effective dosage can be administered in one or more administrations. For purposes of this invention, an effective dosage of drug, compound, or pharmaceutical composition is an amount sufficient to accomplish prophylactic or therapeutic treatment either directly or indirectly. As is understood in the clinical context, an effective dosage of a drug, compound, or pharmaceutical composition may or may not be achieved in conjunction with another drug, compound, or pharmaceutical composition. Thus, an "effective dosage" may be considered in the context of administering one or more therapeutic agents, and a single agent may be considered to be given in an effective amount if, in conjunction with one or more other agents, a desirable result may be or is achieved.

As used herein, the term "subject" refers to any vertebrate including, without limitation, humans and other primates (e.g., chimpanzees, cynomologous monkeys, and other apes and monkey species), farm animals (e.g., cattle, sheep, pigs, goats and horses), sport animals, pets including domestic mammals (e.g., dogs and cats), laboratory animals (e.g., rabbits, rodents such as mice, rats, and guinea pigs), and birds (e.g., domestic, wild and game birds such as chickens, turkeys and other gallinaceous birds, ducks, geese, and the like). In some embodiments, the subject is a mammal. In exemplary embodiments, the subject is a human.

As used herein, "vector" means a construct, which is capable of delivering, and, preferably, expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors encapsulated in liposomes, and certain eukaryotic cells, such as producer cells.

As used herein, "pharmaceutically acceptable carrier" or "pharmaceutical acceptable excipient" includes any material which, when combined with an active ingredient, allows the ingredient to retain biological activity and is non-reactive with the subject's immune system. Examples include, but are not limited to, any of the standard pharmaceutical carriers such as a phosphate buffered saline solution, water, emulsions such as oil/water emulsion, and various types of wetting agents. Preferred diluents for aerosol or parenteral administration are phosphate buffered saline (PBS) or normal (0.9%) saline. Compositions comprising such carriers are formulated by well-known conventional methods (see, for example, Remington's Pharmaceutical Sciences, 18th edition, A. Gennaro, ed., Mack Publishing Co., Easton, PA, 1990; and Remington, The Science and Practice of Pharmacy 21st Ed. Mack Publishing, 2005).

Reference to "about" a value or parameter herein includes (and describes) embodiments that are directed to that value or parameter per se. For example, description referring to "about X" includes description of "X." Numeric ranges are inclusive of the numbers defining the range.

It is understood that wherever embodiments are described herein with the language "comprising," otherwise analogous embodiments described in terms of "consisting of" and/or "consisting essentially of" are also provided.

Where aspects or embodiments of the invention are described in terms of a Markush group or other grouping of alternatives, the invention encompasses not only the entire group listed as a whole, but each member of the group individually and all possible subgroups of the main group, but also the main group absent one or more of the group members. The invention also envisages the explicit exclusion of one or more of any of the group members in the claimed invention.

Unless otherwise defined, all technical and scientific terms used herein have the same meaning as commonly understood by one of ordinary skill in the art to which this invention belongs. In case of conflict, the present specification, including definitions, will control. Throughout this specification and claims, the word "comprise," or variations such as "comprises" or "comprising" will be understood to imply the inclusion of a stated integer or group of integers but not the exclusion of any other integer or group of integers. Unless otherwise required by context, singular terms shall include pluralities and plural terms shall include the singular.

Exemplary methods and materials are described herein, although methods and materials similar or equivalent to those described herein can also be used in the practice or testing of the invention. The materials, methods, and examples are illustrative only and not intended to be limiting.

Inducible Chimeric Cytokine Receptors and Improved Isolated Immune Cells

Inducible chimeric cytokine receptors, cells comprising such receptors, and methods comprising such cells are provided herein. Also provided are uses of such inducible chimeric cytokine receptors for improving the functional activities of isolated immune cells, e.g., isolated T cells, such as isolated T cells comprising chimeric antigenic receptor (CAR). The methods and compositions provided herein are useful for improving in vivo and in vitro persistence, cytotoxicity, memory phenotype, and/or therapeutic efficacy of immune cells comprising CARs, such as CAR-T cells.

In some embodiments, an inducible chimeric cytokine receptor provided herein comprises, in any order: a dimerization domain, a tyrosine kinase activating domain, and a tyrosine effector domain. Optionally, an inducible chimeric cytokine receptor provided herein can include a membrane-targeting motif. Ligand-mediated dimerization of an inducible chimeric cytokine receptor provided herein induces receptor-mediated signaling events in host cells containing the inducible chimeric cytokine receptor. In some embodiments, this signaling can result in improved persistence. For example, in an exemplary embodiment, dimerization of the inducible chimeric cytokine receptor provided herein by a ligand would activate the JAK-STAT pathway and mimic signaling induced by a natural cytokine receptor. By "mimic", it is meant that the signaling cascade activated by the inducible chimeric cytokine receptor of the present disclosure would be similar to the signaling cascade activated by a natural cytokine receptor, while the magnitude of activation induced by the chimeric cytokine receptors of the present disclosure could be different from that of a natural cytokine receptor. For example, if an inducible chimeric cytokine receptor of the present disclosure and a natural cytokine receptor both activate a STAT transcription factor; it is possible that the level of activation of STAT by the two receptors can be similar or different.

The "dimerization domain" of an inducible chimeric cytokine receptor may be any amino acid sequence that can be induced to dimerize or even trimerize or multimerize by a ligand that can bind to the dimerization domain. Accordingly, the dimerization domain is a ligand binding domain. In some embodiments, the dimerization domain of an inducible chimeric cytokine receptor provided herein can be present outside the cell membrane. In some embodiments, the dimerization domain of an inducible chimeric cytokine receptor can be present inside the cell.

In some embodiments, the ligand that binds to the dimerization domain is a dimeric ligand. For example, the dimerization domain may contain the amino acid sequence of an FK506 Binding Protein ("FKBP"). The FKBP protein specifically binds to the drug FK506. Ligands that are multimeric analogs of FK506 (i.e. ligands which contain at least two copies of FK506, or derivatives thereof) can induce the dimerization of a first protein and second protein that each contain the amino acid sequence of an FKBP, by the ligand binding to both the first protein and second protein, and thereby bringing them together. The first and the second protein can be identical or different. Thus, inducible chimeric cytokine receptors provided herein may be induced to dimerize by exposure of the inducible chimeric cytokine receptor to a suitable dimeric ligand which binds to the dimerization domain of the inducible chimeric cytokine receptor.

In some embodiments, a dimerization domain of an inducible chimeric cytokine receptor provided herein may contain amino acid sequences of or derived from, for example, FKBPs, cyclophilins, steroid binding proteins, estrogen binding proteins, glucocorticoid binding proteins, vitamin D binding proteins, or tetracycline binding proteins. As used herein, an "FKBP polypeptide", "cyclophilin polypeptide" or like refers to a polypeptide having the amino acid sequence of the respective protein, or a portion thereof or variant thereof, wherein the portion or variant thereof retains the ability to bind to the corresponding ligand (e.g. for a FKBP polypeptide, the ligand FK506 and related molecules) with high affinity.

In some embodiments, a dimerization domain of an inducible chimeric cytokine receptor provided herein may contain amino acid sequences of, or derived from, the extracellular domains of a cytokine receptor such as, for example without limitation, erythropoietin receptor, prolactin receptor, growth hormone receptor, thrombopoietin receptor, granulocyte colony-stimulating factor receptor, GP130, the common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, TGFBR1/ALKL5, and TGFBR2. In some embodiments, a dimerization domain of an inducible chimeric cytokine receptor provided herein may contain amino acid sequences of or derived from the extracellular domains of receptor tyrosine kinases (RTK) such as EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, and RTK106. The extracellular domains of cytokine receptors and RTKs may be dimerized by the corresponding ligand or agonist (e.g., for a thrombopoietin receptor polypeptide, corresponding ligands included, for example, TPO, eltrombopag, and related molecules).

In some embodiments, a dimerization domain of an inducible chimeric cytokine receptor provided herein may contain amino acid sequences of or derived from, for example, the extracellular domains of TNFR family receptors such as TNFR1, Fas, TRAILR1, TRAILR2, NGFR, DR3, DR6, EDAR, TNFR2, LTbR, OX40, CD40, CD27, CD30, 4-1BB, RANK, Fn14, TACI, BAFFR, HVEM, BCMA, GITR, TROY, RELT, XEDAR, TRAILR3, TRAILR4, OPG, DcR3. The extracellular domain of TNFR family receptors multimerize upon binding to a trimeric TNFR ligand. An exemplary dimerization domain amino acid sequence that is derived from a TNFR family receptor (containing the BCMA extracellular domain) is:

(SEQ ID NO: 216)
MLQMAGQCSQNEYFDSLLHACIPCQLRCSSNTPPLTCQRYCNASVTNSVK

GTNA.

In some embodiments, a dimerization domain of an inducible chimeric cytokine receptor provided herein may contain amino acid sequences of or derived from, for example, the extracellular domains of immune co-receptors or ligands such as PD-1, CD80, CD86, ICOS-L, ICOS, CTLA-4, BTLA, CD160, LAG3, or TIM3. The extracellular domains of immune co-receptors cluster upon binding a cell presenting the corresponding ligand. An exemplary dimerization domain amino acid sequence that is derived from an immune co-receptor (containing the PD-1 extracellular) is:

(SEQ ID NO: 217)
MQIPQAPWPVVWAVLQLGWRPGWFLDSPDRPWNPPTFSPALLVVTEGDNA

TFTCSFSNTSESFVLNWYRMSPSNQTDKLAAFPEDRSQPGQDCRFRVTQL

PNGRDFHMSVVRARRNDSGTYLCGAISLAPKAQIKESLRAELRVTERRAE

VPTAHPSPSPRPAGQFQTLV.

In some embodiments, the dimerization domain may contain an FKBP polypeptide amino acid sequence. FKBPs are a group of proteins that have prolyl isomerase activity and bind to the drug FK506 and other related drugs.

Optionally, the FKBP may be human FKBP12 (also known as FKBP1A; GenBank: CAG46965.1). Optionally, a FKBP12 polypeptide may contain the F36V mutation. FKBP12 containing the F36V mutation binds with high affinity to the dimeric ligand AP1903 (Jemal, A. et al., CA Cancer J. Clinic. 58, 71-96 (2008); Scher, H. I. and Kelly, W. K., Journal of Clinical Oncology 11, 1566-72 (1993)). In addition, FKBP12 containing the F36V mutation binds to AP1903 with much higher affinity than wild-type FKBP12 binds AP1903.

An exemplary dimerization domain amino acid sequence (containing an FKBP12 polypeptide with the F36V mutation) is:

(SEQ ID NO: 218)
GVQVETISPGDGRTFPKRGQTCVVHYTGMLEDGKKVDSSRDRNKPFKFML

GKQEVIRGWEEGVAQMSVGQRAKLTISPDYAYGATGHPGIIPPHATLVFD

VELLKLES.

In some embodiments, a dimerization domain of an inducible chimeric cytokine receptor may contain an amino acid sequence of an FKBP comprising a modification selected from the group consisting of: (i) a FKBP polypeptide containing one or more amino acid substitutions, (ii) two or three tandem repeats of an unmodified (naturally occurring) FKBP amino acid sequence, and (iii) two or three tandem repeats of a FKBP polypeptide containing one or more amino acid substitutions. In some embodiments, the FKBP protein is a human FKBP protein (GenBank: CAG46965.1) and the modifications to FKBP described herein are made to the human FKBP protein. In some embodiments, the one or more amino acid substitutions in FKBP include one or more of: F36V, L106P, E31G, R71G, and K105E, residues in reference to the human FKBP protein (GenBank: CAG46965.1). In the embodiments, where the dimerization domain comprises two or three tandem repeats of the dimerization domain sequences disclosed herein, each repeat may comprise a different mutation of that sequence. For example, in an exemplary embodiment, the dimerization domain comprises three tandem repeats of an FKBP sequence, where one of the repeats comprises a natural FKBP sequence, a second repeat comprises FKBP containing F36V substitution, and a third repeat comprises FKBP containing F36V and L106P substitutions, in any order.

In some embodiments, a dimerization domain of an inducible chimeric cytokine receptor may contain an amino acid sequence of an FKBP comprising a modification selected from the group consisting of: (i) a FKBP polypeptide containing F36V substitution, (ii) a FKBP polypeptide containing F36V and L106P substitutions, (iii) a FKBP polypeptide containing E31G, F36V, R71G, and K105E substitutions, and (iv) two or three tandem repeats of any of these FKBP polypeptides.

In some embodiments, a dimerization domain may be cyclophilin polypeptide amino acid sequence. Cyclophilins are proteins that bind to ciclosporin (cyclosporin A). Cyclophilins include, for example, cyclophilin A and cyclophilin D.

In some embodiments, a dimerization domain may have any of the characteristics of the ligand binding region disclosed in U.S. Pat. No. 9,434,935, which is hereby incorporated by reference for all purposes.

In some embodiments, a dimerization domain of an inducible chimeric cytokine receptor of the present disclosure may comprise an amino acid sequence of, or derived from, a polypeptide selected from the group consisting of: FKBP12(F36V), an extracellular domain of OX-40, and an extracellular domain of a TNFR2 superfamily receptors (e.g., BCMA, TACI, BAFFR).

In some embodiments, a dimerization domain of an inducible chimeric cytokine receptor provided herein comprises a dimerization domain amino acid sequence disclosed in Table 1B.

As used herein, a "dimeric" ligand may optionally contain more than two copies of a suitable binding molecule (i.e. the ligand may be multimeric); however, such ligands may still be considered "dimeric" as used herein, based on the ability of such ligands to dimerize corresponding binding molecules. Similarly, in some embodiments, a "dimerization domain" as provided herein may be capable of supporting multimerization (e.g. in the event that multiple copies of the dimerization domain are provided in the same molecule); however, such domains may also still be considered "dimerization domains" as used herein, based on the ability of such domains to dimerize. Typically, caspase-9 signaling can be effectively induced upon dimerization of caspase-9 molecules (i.e. trimerization or other multimerization is not required). In addition, references herein to a "ligand" are to a dimeric ligand (for example, when referring to a "ligand" which induces dimerization of a chimeric caspase-9 protein provided herein), unless the context clearly dictates otherwise.

As used herein, a tyrosine kinase activating domain of an inducible chimeric cytokine receptor provided herein may comprise a transmembrane domain followed by a Janus Kinase (JAK) binding domain or the tyrosine kinase of a RTK. JAK and RTK kinases are activated by multimerization. JAKs include JAK1, JAK2, JAK3, and TYK2, and bind to a juxtamembrane motif consisting of a Box 1 and Box 2 motif. An exemplary tyrosine kinase activating domain amino acid sequence that activates a JAK2 kinase (containing the Erythropoietin Receptor transmembrane, Box 1, and Box 2 motifs) is:

(SEQ ID NO: 219)
SEPVSGPTPSDLDPLILTLSLILVVILVLLTVLALLSHRRALKQKIWPGI

PSPESEFEGLFTTHKGNFQLWLYQNDGCLWWSPCTPFTEDPPASLEVLSE

RC.

In some embodiments, the transmembrane domain may contain mutations that reduce ligand-independent dimerization.

In some embodiments, the tyrosine kinase activating domain of an inducible chimeric cytokine receptor provided herein comprises a JAK binding domain of, or derived from, a protein. In some embodiments, the protein is a receptor. In some embodiments, the protein is a hormone receptor or a cytokine receptor.

In some embodiments, the tyrosine kinase activating domain comprises a JAK binding domain of, or derived from, a protein selected from the prolactin receptor (PRLR), growth hormone receptor (GHR), thrombopoietin receptor/myeloproliferative leukemia protein receptor (TPOR/MPLR), erythropoietin receptor (EPOR), granulocyte colony-stimulating factor receptor (GCSFR), or GP130. The term "derived from" means one or more modifications are made to the natural sequence. For example, only a portion of the natural sequence may be used, or the natural sequence may be modified to contain a substitution, insertion, and/or deletion mutations, or a combination of these modifications. In some embodiments, the JAK binding domain comprises a JAK binding domain of, or derived from, TPOR or EPOR.

In some embodiments, the tyrosine kinase activating domain of an inducible chimeric cytokine receptor provided herein comprises a transmembrane domain of, or derived from, a protein selected from the PRLR, GHR, TPOR/MPLR, EPOR, GCSFR, and GP130.

In some embodiments, the tyrosine kinase activating domain of an inducible chimeric cytokine receptor provided herein comprises a transmembrane domain of, or derived from, PD-1. In these embodiments, the tyrosine kinase activating domain further comprises a JAK-binding domain or a tyrosine kinase domain of, or derived from, a receptor as described herein.

In some embodiments, the tyrosine kinase activating domain of an inducible chimeric cytokine receptor provided herein comprises a transmembrane domain and a JAK-binding domain or a transmembrane domain and a tyrosine kinase domain, wherein the transmembrane domain is derived from a cytokine/hormone receptor (e.g., TpoR), a monomerized cytokine/hormone receptor (e.g., EpoR L241G L242P), or monomeric receptors (e.g., PD1). "Monomerized cytokine/hormone receptor" as used herein refers to a cytokine receptor or a hormone receptor that is a homodimer or a heterodimer in natural form but is mutated to exist as a monomeric receptor.

In some embodiments, the tyrosine kinase activating domain of an inducible chimeric cytokine receptor provided herein comprises a transmembrane domain of, or derived from, TPOR/MPLR. An exemplary full length sequence of naturally occurring TPOR/MPLR is shown in Table 1A (SEQ ID NO.: 64). In some embodiments, the tyrosine kinase activating domain comprises a transmembrane domain of, or derived from, the TPOR/MPLR sequence shown in Table 1A. For example, in some embodiments, the tyrosine kinase activating domain comprises amino acids 478-582 of TPOR/MPLR shown in Table 1A (this sequence is also shown as "TPOR/MPLR (478-582) (wildtype sequence)" in Table 1C).

In some other embodiments, the tyrosine kinase activating domain comprises a sequence derived from amino acids 478-582 of TPOR/MPLR shown in Table 1A. In these embodiments, the tyrosine kinase activating domain of an inducible chimeric cytokine receptor comprises a sequence derived from amino acids 478-582 of TPOR/MPLR shown in Table 1A, wherein the sequence comprises one or more mutations selected from the group consisting of substitution, deletion, insertion, and combinations thereof. In an exemplary embodiment, the tyrosine kinase activating domain comprises a deletion variant of the amino acid sequence 478-582 of TPOR/MPLR shown in Table 1A. In some embodiments, the deletion variant comprises a deletion of 1, 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 4, 1 to 3, 1 to 2, amino acids from the region 478-582 of TPOR/MPLR shown in Table 1A. In some embodiments, the deletion variant comprises a deletion of 1, 1 to 20, 1 to 19, 1 to 18, 1 to 17, 1 to 16, 1 to 15, 1 to 14, 1 to 13, 1 to 12, 1 to 11, 1 to 10, 1 to 9, 1 to 8, 1 to 7, 1 to 6, 1 to 5, 1 to 4, 1 to 3, 1 to 2, amino acids from the region 489-510 of TPOR/MPLR shown in Table 1A. In an exemplary embodiment, the tyrosine kinase activating domain comprises a deletion variant of the amino acid sequence 478-582 of TPOR/MPLR shown in Table 1C.

In some embodiments, the tyrosine kinase activating domain comprises an insertion variant of the amino acid sequence 478-582 of TPOR/MPLR shown in Table 1A. In some embodiments, the insertion variant comprises an insertion of 1, 1 to 10, 1 to 9, 1 to 8, 1 to 7, 1 to 6, 1 to 5, 1 to 4, 1 to 3, 1 to 2, amino acids in the region 478-582 of TPOR/MPLR shown in Table 1A. In an exemplary embodiment, the tyrosine kinase activating domain comprises an insertion variant of the amino acid sequence 478-582 of TPOR/MPLR shown in Table 1C. In some embodiments, the amino acids that are inserted into the insertion variants are selected from the group consisting of: leucine, valine, and isoleucine.

In some embodiments, the tyrosine kinase activating domain of an inducible chimeric cytokine receptor comprises a sequence derived from amino acids 478-582 of TPOR/MPLR shown in Table 1A, wherein the sequence comprises a combination of deletions and insertions of amino acids in this region. In an exemplary embodiment, the tyrosine kinase activating domain of an inducible chimeric cytokine receptor comprises a sequence derived from amino acids 478-582 of TPOR/MPLR shown in Table 1A, wherein the sequence comprises a deletion of 1 to 18 amino acids from the region 478-582 and an insertion of 1 to 8 amino acids in the region 478-582. In another exemplary embodiment, the tyrosine kinase activating domain of an inducible chimeric cytokine receptor comprises a sequence derived from amino acids 489-510 of TPOR/MPLR shown in Table 1A, wherein the sequence comprises a deletion of 1 to 18 amino acids from the region 489-510 and an insertion of 1 to 8 amino acids in the region 489-510. In some embodiments, the amino acids that are inserted into the insertion variants are selected from the group consisting of: leucine, valine, and isoleucine.

In some embodiments, the tyrosine kinase activating domain of an inducible chimeric cytokine receptor comprises a sequence disclosed in Table 1C.

In some embodiments, the tyrosine kinase activating domain of an inducible chimeric cytokine receptor comprises a deletion and/or insertion variant of the transmembrane domain of PRLR, GHR, EPOR, GCSFR, or GP130. Exemplary full length sequences of naturally occurring PRLR, GHR, EPOR, GCSFR, and GP130 are disclosed in Table 1A along with their accession numbers. From this disclosure, the transmembrane domains of PRLR, GHR, EPOR, GCSFR, and GP130 can be located and insertion and/or deletion variants of these transmembrane domains can be prepared.

In some embodiments, the transmembrane and/or the JAK binding domain of the tyrosine kinase activating domain may be derived from, for example, the common gamma chain receptor, common beta chain receptor, IFN alpha receptor (IFNAR), IFN gamma receptor (IFNGR), IFN lambda receptor (IFNLR), IL2/IL15 receptor (IL2R/IL15R), IL3 receptor (IL3R), IL4 receptor (IL4R), IL5 receptor (IL5R), IL7 receptor (IL7R), IL9 receptor (IL9R), IL10 receptor (IL10R), IL12 receptor (IL12R), IL13 receptor (IL13R), IL20 receptor (IL20R), IL21 receptor (IL21R), IL22 receptor (IL22R), IL23 receptor (IL23R), IL27 receptor (IL27R), TSLP Receptor (TSLPR), G-CSF receptor (GCSFR), GM-CSF receptor (GMCSFR), CNTF receptor (CNTFR), OSM receptor (OSMR), LIF receptor (LIFR), or CT-1 receptor (CT1R).

In some embodiments, the tyrosine kinase activating domain of an inducible chimeric cytokine receptor provided herein comprises a tyrosine kinase domain of, or derived from, a receptor tyrosine kinase (RTK). An exemplary tyrosine kinase activating domain from a RTK that activates a RTK kinase (containing the Epidermal Growth Factor Receptor transmembrane and kinase domains) is:

(SEQ ID NO: 220)
GLEGCPTNGPKIPSIATGMVGALLLLLVVALGIGLFMRRRHIVRKRTLRR

LLQERELVEPLTPSGEAPNQALLRILKETEFKKIKVLGSGAFGTVYKGLW

IPEGEKVKIPVAIKELREATSPKANKEILDEAYVMASVDNPHVCRLLGIC

LTSTVQLITQLMPFGCLLDYVREHKDNIGSQYLLNWCVQIAKGMNYLEDR

RLVHRDLAARNVLVKTPQHVKITDFGLAKLLGAEEKEYHAEGGKVPIKWM

ALESILHRIYTHQSDVWSYGVTVWELMTFGSKPYDGIPASEISSILEKGE

RLPQPPICTIDVYMIMVKCWMIDADSRPKFRELIIEFSKMARDPQRYL.

In some embodiments, the tyrosine kinase activating domain comprises a transmembrane domain and a tyrosine kinase domain derived from other RTKs such as, for example, EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, or RTK106.

In some embodiments, the tyrosine kinase activating domain comprises a tyrosine kinase domain of, or derived from, EGFR.

In some embodiments, the tyrosine kinase activating domain comprises a tyrosine kinase activating domain sequence disclosed in Table 1B.

In some embodiments, a tyrosine effector domain may contain a portion of the cytoplasmic tail (cytotail) of at least one receptor such as a cytokine receptor, hormone receptor, or RTK, or a tyrosine kinase adaptor protein. The "cytotail" as used herein is the portion that contains one or more tyrosine residues that are capable of being phosphorylated by a kinase upon activation. Tyrosines within the cytotail or adaptor protein become phosphorylated by an activated tyrosine kinase. The phosphorylated tyrosine motifs recruit signal transduction factors. An exemplary tyrosine effector domain amino acid sequence from a cytokine receptor (containing the IL2Rb distal cytotail) is:

(SEQ ID NO: 221)
VTQLLLQQDKVPEPASLSSNHSLTSCFTNQG<u>Y</u>FFFHLPDALEIEACQVYF

T<u>Y</u>DP<u>Y</u>SEEDPDEGVAGAPTGSSPQPLQPLSGEDDA<u>Y</u>CTFPSRDDLLLFSP

SLLGGPSPPSTAPGGSGAGEERMPPSLQERVPRDWDPQPLGPPTPGVPDL

VDFQPPPELVLREAGEEVPDAGPREGVSFPWSRPPGQGEFRALNARLPLN

TDA<u>Y</u>LSLQELQGQDPTHLV.

The cytotails of certain receptors, such as cytokine receptors and hormone receptors, comprise STAT-activation domains (can also be referred to herein as STAT-binding domains). In some embodiments, the tyrosine effector domain of the inducible chimeric cytokine receptors provided herein comprises at least one STAT-activation domain of, or derived from, a receptor. In some embodiments, the tyrosine effector domain of the inducible chimeric cytokine receptors provided herein comprises at least two, three, four, or more STAT-activation domains of, or derived from, two, three, four, or more receptors. The receptors can be cytokine receptors and/or hormone receptors.

In some embodiments, the tyrosine effector domain of an inducible chimeric cytokine receptor comprises a cytotail (a portion of the cytoplasmic tail that contains one or more tyrosine residues that are capable of being phosphorylated by a kinase) of, or derived from, at least one, two, three, four, or more receptors (e.g., cytokine receptor, hormone receptor, or RTK) or tyrosine kinase adaptor proteins. In an exemplary embodiment, the tyrosine effector domain of an inducible chimeric cytokine receptor comprises a cytotail of, or derived from, a cytokine receptor and a cytotail of, or derived from, a hormone receptor. In another exemplary embodiment, the tyrosine effector domain of an inducible chimeric cytokine receptor comprises a cytotail of, or derived from, a cytokine receptor and a cytotail of, or derived from, a RTK. In yet another exemplary embodiment, the tyrosine effector domain of an inducible chimeric cytokine receptor comprises a cytotail of, or derived from, a hormone receptor and a cytotail of, or derived from, a RTK. In yet another exemplary embodiment, the tyrosine effector domain of an inducible chimeric cytokine receptor comprises a cytotail of, or derived from, a hormone receptor; a cytotail of, or derived from, a RTK; and a cytotail of, or derived from, a cytokine receptor. Similar combinations of cytotails where at least one of the cytotails comprises a phosphorylatable tyrosine-containing portion of a tyrosine kinase adaptor protein are contemplated. When the tyrosine effector domain of an inducible chimeric cytokine receptor comprises more than one cytotail, the cytotails can be present in any order.

In some embodiments, the tyrosine effector domain of the inducible chimeric cytokine receptors comprises a STAT-activation domain of, or derived from, two cytokine receptors. In some embodiments, the tyrosine effector domain of the inducible chimeric cytokine receptors comprises a STAT-activation domain of, or derived from, at least one receptor selected from the group consisting of: BLNK (B-cell linker protein), IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R. When the tyrosine effector domain comprises more than one STAT-activation domain, the STAT-activation domains are in tandem with one domain being membrane-proximal and the other domain(s) being membrane-distal.

In some embodiments, the tyrosine effector domain of an inducible chimeric cytokine receptor comprises a cyotail of, or derived from, a first receptor selected from the group consisting of: BLNK, IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R, and a cytotail of, or derived from, a second receptor selected from the group consisting of: BLNK, IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R. In these embodiments, the cyotail from the first receptor can be membrane-proximal and the cyotail from the second receptor can be membrane-distal or vice versa. Similar embodiments, where the tyrosine effector domain of an inducible chimeric cytokine receptor comprises more than two, such as three, four, or more, cytotails from the receptors described in this paragraph are encompassed by the present disclosure.

In some embodiments, the tyrosine effector domain of the inducible chimeric cytokine receptors comprises at least one tyrosine effector domain sequences disclosed in Table 1B. In some embodiments, the tyrosine effector domain comprises at least two tyrosine effector domain sequences disclosed in Table 1B. When more than one tyrosine effector domain sequence disclosed in Table 1B is present, any of the sequence can be membrane-proximal and the other sequence(s) can be membrane-distal.

In some embodiments the tyrosine effector domain contains sequences from the cytotail of cytokine receptors such as the common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, Erythropoietin Receptor, Growth Hormone Receptor, Prolactin Receptor, Thrombopoietin receptor, or GP130. An exemplary tyrosine effector domain amino acid sequence from a RTK (containing the EGFR distal cytotail) is:

(SEQ ID NO: 222)
VIQGDERMHLPSPTDSNFYRALMDEEDMDDVVDADEYLIPQQGFFSSPST

SRTPLLSSLSATSNNSTVACIDRNGLQSCPIKEDSFLQRYSSDPTGALTE

DSIDDTFLPVPEYINQSVPKRPAGSVQNPVYHNQPLNPAPSRDPHYQDPH

STAVGNPEYLNTVQPTCVNSTFDSPAHWAQKGSHQISLDNPDYQQDFFPK

EAKPNGIFKGSTAENAEYLRVAPQSSEFIGA.

In some embodiments the tyrosine effector domain contains sequences from the cytotail of RTK such as EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, or RTK106. An exemplary tyrosine effector domain amino acid sequence from a tyrosine kinase adaptor protein (containing the BLNK tyrosine domain) is:

(SEQ ID NO: 223)
ASESPADEEEQWSDDFDSDYENPDEHSDSEMYVMPAEENADDSYEPPPVE

QETRPVHPALPFARGEYIDNRSSQRHSPPFSKTLPSKPSWPSEKARLTST

LPALTALQKPQVPPKPKGLLEDEADYVVPVEDNDENYIHPTESSSPPPEK

APMVNR.

In some embodiments the tyrosine effector domain contains sequences from or bind to adaptor proteins such as ALX, BLNK, Grb7, Nsp, SLP-76, SOCS, TSAd, APS, Bam32, Crk, Gads, Grb2, Nck, SLAP, Shc, FRS2, Dab, Dok, IRS, eps8, AFAP110, Gab, ADAP, Carmal, Cas, CIN85, Cortactin, E3B1, Vinexin, SKAP-55, BANK, BCAP, Dof, Paxillin, LAT, LAX, LIME, NTAL, PAG, SIT, or TRIM.

In some embodiments, the tyrosine effector domain of an inducible chimeric cytokine receptor provided herein may contain sequences from one or more cytokine receptors, RTKs, and/or adaptor proteins. In some embodiments, the sequences may be in tandem. In some embodiments, the tyrosine effect domain may contain, for example, shorter tyrosine-containing peptides from the cytokine receptor, RTK, or tyrosine kinase adaptor protein. In some embodiments, the tyrosine effector domain can be a synthetic sequence capable of binding one or more proteins comprising, for example, phosphor-tyrosine binding protein (PTB) domains, Src homology 2 (SH2) domains, C2 domains, and/or Src homology 3 (SH3) domains.

In some embodiments, an inducible chimeric cytokine receptor provided herein comprises a dimerization domain; a tyrosine kinase activating domain comprising a transmembrane domain and a JAK-binding domain; and a tyrosine effector domain comprising a STAT-activation domain of, or derived from, at least one receptor. In some of these embodiments, the dimerization domain comprises an FKBP polypeptide; the transmembrane domain comprises a transmembrane domain of, or derived from, a protein selected from the group consisting of: EPOR, GP130, PRLR, GHR, GCSFR, PD-1, and TPOR; the JAK-binding domain comprises a JAK-binding domain of, or derived from, a protein selected from the group consisting of: EPOR, GP130, PRLR, GHR, GCSFR, and TPOR; and the STAT-activation domain comprises a STAT-activation domain of, or derived from, at least one receptor selected from the group consisting of: BLNK, IL2RG, EGFR, EpoR, GHR, IFNAR1, IFNAR2, IFNAR1/2, IFNLR1, IL10R1, IL12Rb1, IL12Rb2, IL21R, IL2Rb, IL2small, IL7R, IL7Ra, IL9R, IL15R, and IL21R.

In some embodiments, an inducible chimeric cytokine receptor provided herein comprises a dimerization domain selected from Table 1B, a tyrosine kinase activating domain selected from Table 1B or Table 1C, and a tyrosine effector domain selected from Table 1B.

In some embodiments, an inducible chimeric cytokine receptor provided herein comprises a sequence selected from Table 2A or Table 2B. In some embodiments, the inducible chimeric cytokine receptor comprises a sequence selected from SEQ ID NOs.: 1-58, 187-215, and 225-311.

Table 1A provides exemplary full length sequences of naturally occurring receptors provided in the disclosure, from which the transmembrane proteins are derived. The sequences provided in Table 1A are reference sequences, in relation to which later mutations are expressed, for example in Tables 1B and 1C.

TABLE 1A

Exemplary Naturally Occurring Receptors

| | SEQ ID |
|---|---|

\>AAI12154.1 Erythropoietin receptor [Homo sapiens]   59
MDHLGASLWPQVGSLCLLLAGAAWAPPPNLPDPKFESKAALLAARGPEELLCFTERL
EDLVCFWEEAASAGVGPGNYSFSYQLEDEPWKLCRLHQAPTARGAVRFWCSLPTA
DTSSFVPLELRVTAASGAPRYHRVIHINEVVLLDAPVGLVARLADESGHVVLRWLPPP
ETPMTSHIRYEVDVSAGNGAGSVQRVEILEGRTECVLSNLRGRTRYTFAVRARMAEP
SFGGFWSAWSEPVSLLTPSDLDPLILTLSLILVVILVLLTVLALLSHRRALKQKIWPGIPS
PESEFEGLFTTHKGNFQLWLYQNDGCLWWSPCTPFTEDPPASLEVLSERCWGTMQ
AVEPGTDDEGPLLEPVGSEHAQDTYLVLDKWLLPRNPPSEDLPGPGGSVDIVAMDE
GSEASSCSSALASKPSPEGASAASFEYTILDPSSQLLRPWTLCPELPPTPPHLKYLYL
VVSDSGISTDYSSGDSQGAQGGLSDGPYSNPYENSLIPAAEPLPPSYVACS \>AAI17403.1 Interleukin 6 signal transducer (GP130, oncostatin   60
M receptor) [Homo sapiens]
MLTLQTWLVQALFIFLTTESTGELLDPCGYISPESPVVQLHSNFTAVCVLKEKCMDYF
HVNANYIVWKTNHFTIPKEQYTIINRTASSVTFTDIASLNIQLTCNILTFGQLEQNVYGITI
ISGLPPEKPKNLSCIVNEGKKMRCEWDRGRETHLETNFTLKSEWATHKFADCKAKRD
TPTSCTVDYSTVYFVNIEVWVEAENALGKVTSDHINFDPVYKVKPNPPHNLSVINSEEL
SSILKLTWTNPSIKSVIILKYNIQYRTKDASTWSQIPPEDTASTRSSFTVQDLKPFTEYV
FRIRCMKEDGKGYWSDWSEEASGITYEDRPSKAPSFWYKIDPSHTQGYRTVQLVWK
TLPPFEANGKILDYEVTLTRWKSHLQNYTVNATKLTVNLTNDRYVATLTVRNLVGKSD
AAVLTIPACDFQATHPVMDLKAFPKDNMLWVEWTTPRESVKKYILEWCVLSDKAPCIT
DWQQEDGTVHRTYLRGNLAESKCYLITVTPVYADGPGSPESIKAYLKQAPPSKGPTV
RTKKVGKNEAVLEWDQLPVDVQNGFIRNYTIFYRTIIGNETAVNVDSSHTEYTLSSLTS
DTLYMVRMAAYTDEGGKDGPEFTFTTPKFAQGEIEAIVVPVCLAFLLTTLLGVLFCFNK
RDLIKKHIWPNVPDPSKSHIAQWSPHTPPRHNFNSKDQMYSDGNFTDVSVVEIEAND
KKPFPEDLKSLDLFKKEKINTEGHSSGIGGSSCMSSSRPSISSSDENESSQNTSSTVQ
YSTVVHSGYRHQVPSVQVFSRSESTQPLLDSEERPEDLQLVDHVDGGDGILPRQQY
FKQNCSQHESSPDISHFERSKQVSSVNEEDFVRLKQQISDHISQSCGSGQMKMFQE
VSAADAFGPGTEGQVERFETVGMEAATDEGMPKSYLPQTVRQGGYMPQ \>XP_011512371.1 prolactin receptor isoform X2 [Homo sapiens]   61
MKENVASATVFTLLLFLNTCLLNGQLPPGKPEIFKCRSPNKETFTCWWRPGTDGGLP
TNYSLTYHREGETLMHECPDYITGGPNSCHFGKQYTSMWRTYIMMVNATNQMGSSF
SDELYVDVTYIVQPDPPLELAVEVKQPEDRKPYLWIKWSPPTLIDLKTGWFTLLYEIRL
KPEKAAEWEIHFAGQQTEFKILSLHPGQKYLVQVRCKPDHGYWSAWSPATFIQIPSD
FTMNDTTVWISVAVLSAVICLIIVWAVALKGYSMVTCIFPPVPGPKIKGFDAHLLEKGKS
EELLSALGCQDFPPTSDYEDLLVEYLEVDDSEDQHLMSVHSKEHPSQGMKPTYLDPD
TDSGRGSCDSPSLLSEKCEEPQANPSTFYDPEVIEKPENPETTHTWDPQCISMEGKI
PYFHAGGSKCSTWPLPQPSQHNPRSSYHNITDVCELAVGPAGAPATLLNEAGKDALK
SSQTIKSREEGKATQQREVESFHSETDQDTPWLLPQEKTPFGSAKPLDYVEIHKVNK
DGALSLLPKQRENSGKPKKPGTPENNKEYAKVSGVMDNNILVLVPDDPHAKNVACFEE
SAKEAPPSLEQNQAEKALANFTATSSKCRLQLGGLDYLDPACFTHSFH \>NP_000154.1 growth hormone receptor isoform 1 precursor   62
[Homo sapiens]
MDLWQLLLTLALAGSSDAFSGSEATAAILSRAPWSLQSVNPGLKTNSSKEPKFTKCR
SPERETFSCHWTDEVHHGTKNLGPIQLFYTRRNTQEWTQEWKECPDYVSAGENSC
YFNSSFTSIWIPYCIKLTSNGGTVDEKCFSVDEIVQPDPPIALNWTLLNVSLTGIHADIQ
VRWEAPRNADIQKGWMVLEYELQYKEVNETKWKMMDPILTTSVPVYSLKVDKEYEV
RVRSKQRNSGNYGEFSEVLYVTLPQMSQFTCEEDFYFPWLLIIIFGIFGLTVMLFVFLF
SKQQRIKMLILPPVPVPKIKGIDPDLLKEGKLEEVNTILAIHDSYKPEFHSDDSWVEFIEL
DIDEPDKTEESDTDRLLSSDHEKSHSNLGVKDGDSGRTSCCEPDILETDFNANDIHE
GTSEVAQPQRLKGEADLLCLDQKNQNNSPYHDACPATQQPSVIQAEKNKPQPLPTE
GAESTHQAAHIQLSNPSSLSNIDFYAQVSDITPAGSWLSPGQKNKAGMSQCDMHPE
MVSLCQENFLMDNAYFCEADAKKCIPVAPHIKVESHIQPSLNQEDIYITTESLTTAAGR
PGTGEHVPGSEMPVPDYTSIHIVQSPQGLILNATALPLPDKEFLSSCGYVSTDQLNKIMP \>XP_016855859.1 granulocyte colony-stimulating factor   63
receptor isoform X1 [Homo sapiens]
MARLGNCSLTWAALIILLLPGSLEECGHISVSAPIVHLGDPITASCIIKQNCSHLDPEPQI
LWRLGAELQPGGRQQRLSDGTQESIITLPHLNHTQAFLSCCLNWGNSLQILDQVELR
AGYPPAIPHNLSCLMNTTSSLICQWEPGPETHLPTSFTLKSFKSRGNCQTGDSILD
CVPKDGQSHCCIPRKHLLLYQNMGIWVQAENALGTSMSPQLCLDPMDVVKLEPPML
RTMDPSPEAAPPQAGCLQLCWEPWQPGLHINQKCELRHKPQRGEASWALVGPLPL
EALQYELCGLLPATAYTLQIRCIRWPLPGHWSDWSPSLELRTTERAPTVRLDTWWRQ
RQLDPRTVQLFWKPVPLEEDSGRIQGYVVSWRPSGQAGAILPLCNTTELSCTFHLPS
EAQEVALVAYNSAGTSRPTPVVFSESRGPALTRLHAMARDPHSLWVGWEPPNPWP
QGYVIEWGLGPPSASNSNKTWRMEQNGRATGFLLKENIRPFQLYEIIVTPLYQDTMG
PSQHVYAYSQEMAPSHAPELHLKHIGKTWAQLEWVPEPPELGKSPLTHYTIPWTNAQ
NQSFSAILNASSRGFVLHGLEPASLYHIHLMAASQAGATNSTVLTLMTLTPEGSELHIIL
GLFGLLLLLTCLCGTAWLCCSPNRKNPLWPSVPDPAHSSLGSWVPTIMEELPGPRQG

TABLE 1A-continued

Exemplary Naturally Occurring Receptors

| | SEQ ID |
|---|---|
| QWLGQTSEMSRALTPHPCVQDAFQLPGLGTPPITKLTVLEEDEKKPVPWESHNSSET<br>CGLPTLVQTYVLQGDPRAVSTQPQSQSGTSDQVLYGQLLGSPTSPGPGHYLRCDST<br>QPLLAGLTPSPKSYENLWFQASPLGTLVTPAPSQEDDCVFGPLLNFPLLQGIRVHGM<br>EALGSF | |
| >NP_005364.1 thrombopoietin receptor precursor<br>[Homo sapiens]<br>MPSWALFMVTSCLLLAPQNLAQVSSQDVSLLASDSEPLKCFSRTFEDLTCFWDEEEA<br>APSGTYQLLYAYPREKPRACPLSSQSMPHFGTRYVCQFPDQEEVRLFFPLHLWVKN<br>VFLNQTRTQRVLFVDSVGLPAPPSIIKAMGGSQPGELQISWEEPAPEISDFLRYELRY<br>GPRDPKNSTGPTVIQLIATETCCPALQRPHSASALDQSPCAQPTMPWQDGPKQTSP<br>SREASALTAEGGSCLISGLQPGNSYWLQLRSEPDGISLGGSWGSWSLPVTVDLPGD<br>AVALGLQCFTLDLKNVTCQWQQQDHASSQGFFYHSRARCCPRDRYPIWENCEEEE<br>KTNPGLQTPQFSRCHFKSRNDSIIHILVEVTTAPGTVHSYLGSPFWIHQAVRLPTPNLH<br>WREISSGHLELEWQHPSSWAAQETCYQLRYTGEGHQDWKVLEPPLGARGGTLELR<br>PRSRYRLQLRARLNGPTYQGPWSSWSDPTRVETATETAWISLVTALHLVLGLSAVLG<br>LLLLRWQFPAHYRRLRHALWPSLPDLHRVLGQYLRDTAALSPPKATVSDTCEEVEPS<br>LLEILPKSSERTPLPLCSSQAQMDYRRLQPSCLGTMPLSVCPPMAESGSCCTTHIANH<br>SYLPLSYWQQP | 64 |

Exemplary amino acid sequences useful in the inducible chimeric cytokine receptors provided herein are shown in Table 1B.

TABLE 1B

| N-terminal membrane targeting motif | Amino acid sequence | SEQ ID |
|---|---|---|
| CD8 signal peptide | MALPVTALLLPLALLLHAARP | 65 |
| Myristoylation Motif | MGSSKSKPKDPSQR | 66 |

| Epitope tag | Amino acid sequence | SEQ ID |
|---|---|---|
| Myc | EQKLISEEDL | 67 |
| V5 | IPNPLLGLDST | 68 |

| Dimerization domain | Amino acid sequence | SEQ ID |
|---|---|---|
| FKBP(F36V) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE | 69 |
| FKBP(F36V)-<br>FKBP(F36V) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLGVQVETISPGDGRTFPKRGQTCVV<br>HYTGMLEDGKKVDSSRDRNKPFKFMLGKQEVI<br>RGWEEGVAQMSVGQRAKLTISPDYAYGATGHP<br>GIIPPHATLVFDVELLKLE | 70 |
| FKBP(F36V, L106P) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKP | 71 |
| FKBP(F36V, L106P)-<br>FKBP(F36V, L106P) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKPGVQVETISPGDGRTFPKRGQTCVV<br>HYTGMLEDKKVDSSRDRNKPFKFMLGKQEVIR<br>GWEEGVAQMSVGQRAKLTISPDYAYGATGHPG<br>IIPPHATLVFDVELLKPE | 72 |
| FKBP(E31G, 36V, R71G, K105E)-<br>FKBP(E31G, 36V, R71G, K105E) | MGVQVETISPGDGRTFPKRGQTCVVHYTGMLG<br>DGKKVDSSRDRNKPFKFMLGKQEVIRGWEEGV<br>AQMSVGQGAKLTISPDYAYGATGHPGIIPPHATL<br>VFDVELLELGVQVETISPGDGRTFPKRGQTCVV | 73 |

TABLE 1B-continued

| | | |
|---|---|---|
| | HYTGMLGDGKKVDSSRDRNKPFKFMLGKQEVI RGWEEGVAQMSVGQGAKLTISPDYAYGATGHP GIIPPHATLVFDVELLELE | |
| ALK5/TGFBR1(1-126) | MEAAVAAPRPRLLLLVLAAAAAAAAALLPGATAL QCFCHLCTKDNFTCVTDGLCFVSVTETTDKVIH NSMCIAEIDLIPRDRPFVCAPSSKTGSVTTTYCC NQDHCNKIELPTTVKSSPGLGPVEL | 74 |
| TGFBR2(1-166) | MGRGLLRGLWPLHIVLWTRIASTIPPHVQKSVN NDMIVTDNNGAVKFPQLCKFCDVRFSTCDNQK SCMSNCSITSICEKPQEVCAVWRKNDENITLET VCHDPKLPYHDFILEDAASPKCIMKEKKKPGETF FMCSCSSDECNDNIIFSEEYNTSNPDLLLVIFQ | 75 |
| EpoR(1-236) | MDHLGASLWPQVGSLCLLLAGAAWAPPPNLPD PKFESKAALLAARGPEELLCFTERLEDLVCFWE EAASAGVGPGNYSFSYQLEDEPWKLCRLHQAP TARGAVRFWCSLPTADTSSFVPLELRVTAASGA PRYHRVIHINEVVLLDAPVGLVARLADESGHVVL RWLPPPETPMTSHIRYEVDVSAGNGAGSVQRV EILEGRTECVLSNLRGRTRYTFAVRARMAEPSF GGFWSAW | 76 |
| PrlR(1-220) | MKENVASATVFTLLLFLNTCLLNGQLPPGKPEIF KCRSPNKETFTCWWRPGTDGGLPTNYSLTYHR EGETLMHECPDYITGGPNSCHFGKQYTSMWRT YIMMVNATNQMGSSFSDELYVDVTYIVQPDPPL ELAVEVKQPEDRKPYLWIKWSPPTLIDLKTGWF TLLYEIRLKPEKAAEWEIHFAGQQTEFKILSLHPG QKYLVQVRCKPDHGYWSAWSP | 77 |
| GHR(1-250) | MDLWQLLLTLALAGSSDAFSGSEATAAILSRAP WSLQSVNPGLKTNSSKEPKFTKCRSPERETFSC HWTDEVHHGTKNLGPIQLFYTRRNTQEWTQEW KECPDYVSAGENSCYFNSSFTSIWIPYCIKLTSN GGTVDEKCFSVDEIVQPDPPIALNWTLLNVSLTG IHADIQVRWEAPRNADIQKGWMVLEYELQYKEV NETKWKMMDPILTTSVPVYSLKVDKEYEVRVRS KQRNSGNYGEFSEVLYVT | 78 |
| TPOR/MPLR(1-478) | MPSWALFMVTSCLLLAPQNLAQVSSQDVSLLAS DSEPLKCFSRTFEDLTCFWDEEEAAPSGTYQLL YAYPREKPRACPLSSQSMPHFGTRYVCQFPDQ EEVRLFFPLHLWVKNVFLNQTRTQRVLFVDSVG LPAPPSIIKAMGGSQPGELQISWEEPAPEISDFL RYELRYGPRDPKNSTGPTVIQLIATETCCPALQR PHSASALDQSPCAQPTMPWQDGPKQTSPSRE ASALTAEGGSCLISGLQPGNSYWLQLRSEPDGI SLGGSWGSWSLPVTVDLPGDAVALGLQCFTLD LKNVTCQWQQQDHASSQGFFYHSRARCCPRD RYPIWENCEEEEKTNPGLQTPQFSRCHFKSRN DSIIHILVEVTTAPGTVHSYLGSPFWIHQAVRLPT PNLHWREISSGHLELEWQHPSSWAAQETCYQL RYTGEGHQDWKVLEPPLGARGGTLELRPRSRY RLQLRARLNGPTYQGPWSSW | 79 |
| EGFR(1-631) | MRPSGTAGAALLALLAALCPASRALEEKKVCQG TSNKLTQLGTFEDHFLSLQRMFNNCEVVLGNLEI TYVQRNYDLSFLKTIQEVAGYVLIALNTVERIPLE NLQIIRGNMYYENSYALAVLSNYDANKTGLKELP MRNLQEILHGAVRFSNNPALCNVESIQWRDIVS SDFLSNMSMDFQNHLGSCQKCDPSCPNGSCW GAGEENCQKLTKIICAQQCSGRCRGKSPSDCC HNQCAAGCTGPRESDCLVCRKFRDEATCKDTC PPLMLYNPTTYQMDVNPEGKYSFGATCVKKCP RNYVVTDHGSCVRACGADSYEMEEDGVRKCK KCEGPCRKVCNGIGIGEFKDSLSINATNIKHFKN CTSISGDLHILPVAFRGDSFTHTPPLDPQELDILK TVKEITGFLLIQAWPENRTDLHAFENLEIIRGRTK QHGQFSLAVVSLNITSLGLRSLKEISDGDVIISGN KNLCYANTINWKKLFGTSGQKTKIISNRGENSCK ATGQVCHALCSPEGCWGPEPRDCVSCRNVSR GRECVDKCNLLEGEPREFVENSECIQCHPECLP QAMNITCTGRGPDNCIQCAHYIDGPHCVKTCPA GVMGENNTLVWKYADAGHVCHLCHPNCTYGC TGP | 80 |
| FGFR1(1-362) | MWSWKCLLFWAVLVTATLCTARPSPTLPEQAQ PWGAPVEVESFLVHPGDLLQLRCRLRDDVQSIN | 81 |

TABLE 1B-continued

| | | |
|---|---|---|
| | WLRDGVQLAESNRTRITGEEVEVQDSVPADSG
LYACVTSSPSGSDTTYFSVNVSDALPSSEDDDD
DDDSSSEEKETDNTKPNRMPVAPYWTSPEKME
KKLHAVPAAKTVKFKCPSSGTPNPTLRWLKNGK
EFKPDHRIGGYKVRYATWSIIMDSVVPSDKGNY
TCIVENEYGSINHTYQLDWERSPHRPILQAGLP
ANKTVALGSNVEFMCKVYSDPQPHIQWLKHIEV
NGSKIGPDNLPYVQILKTAGVNTTDKEMEVLHLR
NVSFEDAGEYTCLAGNSIGLSHHSAWLTVLEAL | |
| PDGFRA(1-514) | MGTSHPAFLVLGCLLTGLSLILCQLSLPSILPNEN
EKVVQLNSSFSLRCFGESEVSWQYPMSEEESS
DVEIRNEENNSGLFVTVLEVSSASAAHTGLYTCY
YNHTQTEENELEGRHIYIYVPDPDVAFVPLGMT
DYLVIVEDDDSAIIPCRTTDPETPVTLHNSEGVVP
ASYDSRQGFNGTFTVGPYICEATVKGKKFQTIPF
NVYALKATSELDLEMEALKTVYKSGETIVVTCAV
FNNEVVDLQWTYPGEVKGKGITMLEEIKVPSIKL
VYTLTVPEATVKDSGDYECAARQATREVKEMKK
VTISVHEKGFIEIKPTFSQLEAVNLHEVKHFVVEV
RAYPPPRISWLKNNLTLIENLTEITTDVEKIQEIRY
RSKLKLIRAKEEDSGHYTIVAQNEDAVKSYTFEL
LTQVPSSILDLVDDHHGSTGGQTVRCTAEGTPL
PDIEWMICKDIKKCNNETSWTILANNVSNIITEIHS
RDRSTVEGRVTFAKVEETIAVRCLAKNLLGAEN
REL | 82 |
| PDGFRB(1-518) | MRLPGAMPALALKGELLLLSLLLLLEPQISQGLV
VTPPGPELVLNVSSTFVLTCSGSAPVVWERMS
QEPPQEMAKAQDGTFSSVLTLTNLTGLDTGEYF
CTHNDSRGLETDERKRLYIFVPDPTVGFLPNDA
EELFIFLTEITEITIPCRVTDPQLVVTLHEKKGDVA
LPVPYDHQRGFSGIFEDRSYICKTTIGDREVDSD
AYYVYRLQVSSINVSVNAVQTVVRQGENITLMCI
VIGNEVVNFEWTYPRKESGRLVEPVTDFLLDMP
YHIRSILHIPSAELEDSGTYTCNVTESVNDHQDE
KAINITVVESGYVRLLGEVGTLQFAELHRSRTLQ
VVFEAYPPPTVLWFKDNRTLGDSSAGEIALSTR
NVSETRYVSELTLVRVKVAEAGHYTMRAFHEDA
EVQLSFQLQINVPVRVLELSESHPDSGEQTVRC
RGRGMPQPNIIWSACRDLKRCPRELPPTLLGNS
SEEESQLETNVTYWEEEQEFEVVSTLRLQHVDR
PLSVRCTLRNAVGQDT | 83 |
| BCMA (1-54) | MLQMAGQCSQNEYFDSLLHACIPCQLRCSSNT
PPLTCQRYCNASVTNSVKGTNA | 84 |
| BAFF-R (1-78) | MRRGPRSLRGRDAPAPTPCVPAECFDLLVRHC
VACGLLRTPRPKPAGASSPAPRTALQPQESVGA
GAGEAALPLPGLL | 85 |
| TACI (1-165) | MSGLGRSRRGGRSRVDQEERFPQGLWTGVAM
RSCPEEQYWDPLLGTCMSCKTICNHQSQRTCA
AFCRSLSCRKEQGKFYDHLLRDCISCASICGQH
PKQCAYFCENKLRSPVNLPPELRRQRSGEVEN
NSDNSGRYQGLEHRGSEASPALPGLKLSADQV
ALVYS | 86 |
| OX40 (1-214) | MCVGARRLGRGPCAALLLLGLGLSTVTGLHCVG
DTYPSNDRCCHECRPGNGMVSRCSRSQNTVC
RPCGPGFYNDVVSSKPCKPCTWCNLRSGSERK
QLCTATQDTVCRCRAGTQPLDSYKPGVDCAPC
PPGHFSPGDNQACKPWTNCTLAGKHTLQPASN
SSDAICEDRDPPATQPQETQGPPARPITVQPTE
AWPRTSQGPSTRPVEVPGGRA | 87 |
| Tyrosine kinase activating domain | Amino acid sequence | SEQ ID |
| CD8(138-206) | TTTPAPRPPTPAPTIASQPLSLRPEACRPAAGGA
VHTRGLDFACDIYIWAPLAGTCGVLLLSLVITLYC | 88 |
| EpoR(237-338; L241G, L242P) | SEPVSGPTPSDLDPLILTLSLILVVILVGPTVLALL
SHRRALKQKIWPGIPSPESEFEGLFTTHKGNFQ
LWLYQNDGCLWWSPCTPFTEDPPASLEVLSERC | 89 |
| EpoR(237-338) | SEPVSGPTPSDLDPLILTLSLILVVILVLLTVLALLS
HRRALKQKIWPGIPSPESEFEGLFTTHKGNFQL
WLYQNDGCLWWSPCTPFTEDPPASLEVLSERC | 90 |

TABLE 1B-continued

| | | |
|---|---|---|
| EpoR(237-282; L241G, L242P) | SEPVSGPTPSDLDPLILTLSLILVVILVGPTVLALL SHRRALKQKI | 91 |
| GP130(609-700) | TTPKFAQGEIEAIVVPVCLAFLLTTLLGVLFCFNK RDLIKKHIWPNVPDPSKSHIAQWSPHTPPRHNF NSKDQMYSDGNFTDVSVVEIEAND | 92 |
| PrlR(221-319) | ATFIQIPSDFTMNDTTVWISVAVLSAVICLIIVWAV ALKGYSMVTCIFPPVPGPKIKGFDAHLLEKGKSE ELLSALGCQDFPPTSDYEDLLVEYLEVDD | 93 |
| GHR(251-352) | LPQMSQFTCEEDFYFPWLLIIIFGIFGLTVMLFVF LFSKQQRIKMLILPPVPVPKIKGIDPDLLKEGKLE EVNTILAIHDSYKPEFHSDDSWVEFIELDIDE | 94 |
| GCSFR(614-710) | LTLMTLTPEGSELHIILGLFGLLLLLTCLCGTAWL CCSPNRKNPLWPSVPDPAHSSLGSWVPTIMEE DAFQLPGLGTPPITKLTVLEEDEKKPVPWE | 95 |
| TPOR/MPLR(478-582) | SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL | 96 |
| TPOR/MPLR(478-528) | SDPTRVETATETAWISLVTALHLVLGLSAVLGLLL LRWQFPAHYRRLRHAL | 97 |
| EGFR(632-979) | GLEGCPTNGPKIPSIATGMVGALLLLLVVALGIGL FMRRRHIVRKRTLRRLLQERELVEPLTPSGEAP NQALLRILKETEFKKIKVLGSGAFGTVYKGLWIPE GEKVKIPVAIKELREATSPKANKEILDEAYVMASV DNPHVCRLLGICLTSTVQLITQLMPFGCLLDYVR EHKDNIGSQYLLNWCVQIAKGMNYLEDRRLVHR DLAARNVLVKTPQHVKITDFGLAKLLGAEEKEYH AEGGKVPIKWMALESILHRIYTHQSDVWSYGVT VWELMTFGSKPYDGIPASEISSILEKGERLPQPPI CTIDVYMIMVKCWMIDADSRPKFRELIIEFSKMA RDPQRYL | 98 |
| FGFR1(363-767) | EERPAVMTSPLYLEIIIYCTGAFLISCMVGSIVIYK MKSGTKKSDFHSQMAVHKLAKSIPLRRQVTVSA DSSASMNSGVLLVRPSRLSSSGTPMLAGVSEY ELPEDPRWELPRDRLVLGKPLGEGCFGQVVLA EAIGLDKDKPNRVTKVAVKMLKSDATEKDLSDLI SEMEMMKMIGKHKNIINLLGACTQDGPLYVIVEY ASKGNLREYLQARRPPGLEYCYNPSHNPEEQL SSKDLVSCAYQVARGMEYLASKKCIHRDLAARN VLVTEDNVMKIADFGLARDIHHIDYYKKTTNGRL PVKWMAPEALFDRIYTHQSDVWSFGVLLWEIFT LGGSPYPGVPVEELFKLLKEGHRMDKPSNCTN ELYMMMRDCWHAVPSQRPTFKQLVEDLDRIVA LTSNQEYL | 99 |
| PDGFRA(515-954) | KLVAPTLRSELTVAAAVLLLVIVIISLIVLVVIWKQ KPRYEIRWRVIESISPDGHEYIYVDPMQLPYDSR WEFPRDGLVLGRVLGSGAFGKVVEGTAYGLSR SQPVMKVAVKMLKPTARSSEKQALMSELKIMTH LGPHLNIVNLLGACTKSGPIYIITEYCFYGDLVNY LHKNRDSFLSHHPEKPKKELDIFGLNPADESTRS YVILSFENNGDYMDMKQADTTQYVPMLERKEV SKYSDIQRSLYDRPASYKKKSMLDSEVKNLLSD DNSEGLTLLDLLSFTYQVARGMEFLASKNCVHR DLAARNVLLAQGKIVKICDFGLARDIMHDSNYVS KGSTFLPVKWMAPESIFDNLYTTLSDVWSYGILL WEIFSLGGTPYPGMMVDSTFYNKIKSGYRMAKP DHATSEVYEIMVKCWNSEPEKRPSFYHLSEIVE NLL | 100 |
| PDGFRB(519-962) | QEVIVVPHSLPFKVVVISAILALVVLTIISLIILMLW QKKPRYEIRWKVIESVSSDGHEYIYVDPMQLPY DSTWELPRDQLVLGRTLGSGAFGQVVEATAHG LSHSQATMKVAVKMLKSTARSSEKQALMSELKI MSHLGPHLNVVNLLGACTKGGPIYIITEYCRYGD LVDYLHRNKHTFLQHHSDKRRPPSAELYSNALP VGLPLPSHVSLTGESDGGYMDMSKDESVDYVP MLDMKGDVKYADIESSNYMAPYDNYVPSAPER TCRATLINESPVLSYMDLVGFSYQVANGMEFLA SKNCVHRDLAARNVLICEGKLVKICDFGLARDIM RDSNYISKGSTFLPLKWMAPESIFNSLYTTLSDV WSFGILLWEIFTLGGTPYPELPMNEQFYNAIKRG | 101 |

TABLE 1B-continued

| | | SEQ ID |
|---|---|---|
| | YRMAQPAHASDEIYEIMQKCWEEKFEIRPPFSQ LVLLLERLL | |
| murine EpoR(236-337; L264G, L265P) | SEPASLLTASDLDPLILTLSLILVLISLGPTVLALLS HRRTLQQKIWPGIPSPESEFEGLFTTHKGNFQL WLLQRDGCLWWSPGSSFPEDPPAHLEVLSEPR | 102 |
| EpoR(273-508) | SHRRALKQKIWPGIPSPESEFEGLFTTHKGNFQ LWLYQNDGCLWWSPCTPFTEDPPASLEVLSER CWGTMQAVEPGTDDEGPLLEPVGSEHAQDTYL VLDKWLLPRNPPSEDLPGPGGSVDIVAMDEGS EASSCSSALASKPSPEGASAASFEYTILDPSSQL LRPWTLCPELPPTPPHLKYLYLVVSDSGISTDYS SGDSQGAQGGLSDGPYSNPYENSLIPAAEPLPP SYVACS | 103 |

| Tyrosine effector domains | Amino acid sequence | SEQ ID |
|---|---|---|
| IL7R(316-459) | ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 134 |
| IL2Rb(333-551) | VTQLLLQQDKVPEPASLSSNHSLTSCFTNQGYF FFHLPDALEIEACQVYFTYDPYSEEDPDEGVAG APTGSSPQPLQPLSGEDDAYCTFPSRDDLLLFS PSLLGGPSPPSTAPGGSGAGEERMPPSLQERV PRDWDPQPLGPPTPGVPDLVDFQPPPELVLRE AGEEVPDAGPREGVSFPWSRPPGQGEFRALNA RLPLNTDAYLSLQELQGQDPTHLV | 135 |
| IFNAR1(508-557) | ISTIATVEETNQTDEDHKKYSSQTSQDSGNYSN EDESESKTSEELQQDFV | 136 |
| IFNAR2(310-515) | KKKVWDYNYDDESDSDTEAAPRTSGGGYTMH GLTVRPLGQASATSTESQLIDPESEEEPDLPEVD VELPTMPKDSPQQLELLSGPCERRKSPLQDPFP EEDYSSTEGSSGGRITFNVDLNSVFLRVLDDEDS DDLEAPLMLSSHLEEMVDPEDPDNVQSNHLLAS GEGTQPTFPSPSSEGLWSEDAPSDQSDTSESD VDLGDGYIMR | 137 |
| IFNAR1/2(IFNAR1 residues 508-557-IFNAR2 residues 310-515) | ISTIATVEETNQTDEDHKKYSSQTSQDSGNYSN EDESESKTSEELQQDFVKKKVWDYNYDDESDS DTEAAPRTSGGGYTMHGLTVRPLGQASATSTE SQLIDPESEEEPDLPEVDVELPTMPKDSPQQLE LLSGPCERRKSPLQDPFPEEDYSSTEGSSGGRIT FNVDLNSVFLRVLDDEDSDDLEAPLMLSSHLEE MVDPEDPDNVQSNHLLASGEGTQPTFPSPSSE GLWSEDAPSDQSDTSESDVDLGDGYIMR | 138 |
| IFNLR1(300-520) | RGVRPTPRVRAPATQQTRWKKDLAEDEEEEDE EDTEDGVSFQPYIEPPSFLGQEHQAPGHSEAG GVDSGRPRAPLVPSEGSSAWDSSDRSWASTV DSSWDRAGSSGYLAEKGPGQGPGGDGHQESL PPPEFSKDSGFLEELPEDNLSSWATWGTLPPEP NLVPGGPPVSLQTLTFCWESSPEEEEARESEI EDSDAGSWGAESTQRTEDRGRTLGHYMAR | 139 |
| Common Gamma Chain(335-369) | IPPKGGALGEGPGASPCNQHSPYWAPPCYTLK PET | 140 |
| IL9R(356-521) | TALLTCGPARPWKSVALEEEQEGPGTRLPGNLS SEDVLPAGCTEWRVQTLAYLPQEDWAPTSLTR PAPPDSEGSRSSSSSSSSNNNNYCALGCYGG WHLSALPGNTQSSGPIPALACGLSCDHQGLETQ QGVAWVLAGHCQRPGLHEDLQGMLLPSVLSKA RSWTF | 141 |
| IL21R(322-538) | PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVVIPPPLSSPGPQAS | 142 |

TABLE 1B-continued

| Name | Sequence | SEQ ID NO |
|---|---|---|
| GHR(353-638) | PDEKTEESDTDRLLSSDHEKSHSNLGVKDGDS GRTSCCEPDILETDFNANDIHEGTSEVAQPQRL KGEADLLCLDQKNQNNSPYHDACPATQQPSVI QAEKNKPQPLPTEGAESTHQAAHIQLSNPSSLS NIDFYAQVSDITPAGSVVLSPGQKNKAGMSQCD MHPEMVSLCQENFLMDNAYFCEADAKKCIPVAP HIKVESHIQPSLNQEDIYITTESLTTAAGRPGTGE HVPGSEMPVPDYTSIHIVQSPQGLILNATALPLP DKEFLSSCGYVSTDQLNKIMP | 143 |
| EpoR(339-508) | WGTMQAVEPGTDDEGPLLEPVGSEHAQDTYLV LDKWLLPRNPPSEDLPGPGGSVDIVAMDEGSE ASSCSSALASKPSPEGASAASFEYTILDPSSQLL RPWTLCPELPPTPPHLKYLYLVVSDSGISTDYSS GDSQGAQGGLSDGPYSNPYENSLIPAAEPLPPS YVACS | 144 |
| murine IL2Rb(337-539) | AVQLLLLQKDSAPLPSPSGHSQASCFTNQGYFF FHLPNALEIESCQVYFTYDPCVEEEVEEDGSRL PEGSPHPPLLPLAGEQDDYCAFPPRDDLLLFSP SLSTPNTAYGGSRAPEERSPLSLHEGLPSLASR DLMGLQRPLERMPEGDGEGLSANSSGEQASVP EGNLHGQDQDRGQGPILTLNTDAYLSLQELQAQ DSVHLI | 145 |
| murine IL7Ra(316-459) | ARDEVESFLPNDLPAQPEELETQGHRAAVHSAN RSPETSVSPPETVRRESPLRCLARNLSTCNAPP LLSSRSPDYRDGDRNRPPVYQDLLPNSGNTNV PVPVPQPLPFQSGILIPVSQRQPISTSSVLNQEE AYVTMSSFYQNK | 146 |
| EGFR(955-1186) | VIQGDERMHLPSPTDSNFYRALMDEEDMDDVV DADEYLIPQQGFFSSPSTSRTPLLSSLSATSNNS TVACIDRNGLQSCPIKEDSFLQRYSSDPTGALTE DSIDDTFLPVPEYINQSVPKRPAGSVQNPVYHN QPLNPAPSRDPHYQDPHSTAVGNPEYLNTVQP TCVNSTFDSPAHWAQKGSHQISLDNPDYQQDF FPKEAKPNGIFKGSTAENAEYLRVAPQSSEFIGA | 147 |
| EGFR(955-1186; Y974F, d1045-1057) | VIQGDERMHLPSPTDSNFFRALMDEEDMDDVV DADEYLIPQQGFFSSPSTSRTPLLSSLSATSNNS TVACIDRNGLQSCPIKEDSFLQRIDDTFLPVPEYI NQSVPKRPAGSVQNPVYHNQPLNPAPSRDPHY QDPHSTAVGNPEYLNTVQPTCVNSTFDSPAHW AQKGSHQISLDNPDYQQDFFPKEAKPNGIFKGS TAENAEYLRVAPQSSEFIGA | 148 |
| EGFR(955-1009; Y974F) | VIQGDERMHLPSPTDSNFFRALMDEEDMDDVV DADEYLIPQQGFFSSPSTSRTP | 149 |
| EGFR(1019-1085) | NNSTVACIDRNGLQSCPIKEDSFLQRIDDTFLPV PEYINQSVPKRPAGSVQNPV | 150 |
| EGFR(1037-1103; Y1068/1101F, d1045-1057) | KEDSFLQRIDDTFLPVPEFINQSVPKRPAGSVQN PVYHNQPLNPAPSRDPHFQD | 151 |
| EGFR(1066-1118; Y1068/1086F) | VPEFINQSVPKRPAGSVQNPVFHNQPLNPAPSR DPHYQDPHSTAVGNPEYLNTV | 152 |
| EGFR(1122-1165) | PEYLNTVQPTCVNSTFDSPAHWAQKGSHQISLD NPDYQQDFFPKEAKPNGIFKG | 153 |
| EGFR(1133-1186; Y1148F) | WAQKGSHQISLDNPDFQQDFFPKEAKPNGIFKG STAENAEYLRVAPQSSEFIGA | 154 |
| IL12Rb2(775-825) | SDPKPENPACPWTVLPAGDLPTHDGYLPSNIDD LPSHEAPLADSLEELEPQ | 155 |
| IL7R(376-416) | ACDAPILSSSRSLDCRESGKNGPHVYQDLLLSL GTTNSTLP | 156 |
| IL7R(424-459) | GILTLNPVAQGQPILTSLGSNQEEAYVTMSSFYQ NQ | 157 |
| IL7R(376-416, 424-459) | ACDAPILSSSRSLDCRESGKNGPHVYQDLLLSL GTTNSTLPQGQPILTSLGSNQEEAYVTMSSFYQ NQ | 158 |

TABLE 1B-continued

| | | |
|---|---|---|
| IL7R(424-459; Y456F) | GILTLNPVAQGQPILTSLGSNQEEAYVTMSSFFQ NQ | 159 |
| IL7R(376-416, 424-459, Y456F) | ACDAPILSSSRSLDCRESGKNGPHVYQDLLLLSL GTTNSTLPQGQPILTSLGSNQEEAYVTMSSFFQ NQ | 160 |
| IL2Rbsmall(393-433) | DEGVAGAPTGSSPQPLQPLSGEDDAYCTFPSR DDLLLFSPSGQGEFRALNARLPLNTDAYLSLQEL QGQDPTHLV | 161 |
| IL2Rbsmall(518-551) | GQGEFRALNARLPLNTDAYLSLQELQGQDPTHLV | 162 |
| IL2Rbsmall(339-379, 393-433) | QQDKVPEPASLSSNHSLTSCFTNQGYFFFHLPD ALEIEACQDEGVAGAPTGSSPQPLQPLSGEDDA YCTFPSRDDLLLFSPS | 163 |
| IL2Rbsmall(339-379, 518-551) | QQDKVPEPASLSSNHSLTSCFTNQGYFFFHLPD ALEIEACQ GQGEFRALNARLPLNTDAYLSLQELQGQDPTHLV | 164 |
| IL2Rbsmall(393-433, 518-551) | DEGVAGAPTGSSPQPLQPLSGEDDAYCTFPSR DDLLLFSPSGQGEFRALNARLPLNTDAYLSLQEL QGQDPTHLV | 165 |
| IL2Rbsmall(339-379, 393-433, 518-551) | QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV | 166 |
| IFNAR2small(310-352) | KKKVWDYNYDDESDSDTEAAPRTSGGGYTMH GLTVRPLGQASA | 167 |
| IFNAR2small(486-515) | EGLWSEDAPSDQSDTSESDVDLGDGYIMR | 168 |
| IFNAR2small(310-352, 486-515) | KKKVWDYNYDDESDSDTEAAPRTSGGGYTMH GLTVRPLGQASA EGLWSEDAPSDQSDTSESDVDLGDGYIMR | 169 |
| BLNK(53-208) | ASESPADEEEQWSDDFDSDYENPDEHSDSEMY VMPAEENADDSYEPPPVEQETRPVHPALPFAR GEYIDNRSSQRHSPPFSKTLPSKPSWPSEKARL TSTLPALTALQKPQVPPKPKGLLEDEADYVVPV EDNDENYIHPTESSSPPPEKAPMVNR | 170 |
| BLNK(53-208; Y72F) | ASESPADEEEQWSDDFDSDFENPDEHSDSEMY VMPAEENADDSYEPPPVEQETRPVHPALPFAR GEYIDNRSSQRHSPPFSKTLPSKPSWPSEKARL TSTLPALTALQKPQVPPKPKGLLEDEADYVVPV EDNDENYIHPTESSSPPPEKAPMVNR | 171 |
| BLNK(53-208; Y72F, Y96F) | ASESPADEEEQWSDDFDSDFENPDEHSDSEMY VMPAEENADDSFEPPPVEQETRPVHPALPFAR GEYIDNRSSQRHSPPFSKTLPSKPSWPSEKARL TSTLPALTALQKPQVPPKPKGLLEDEADYVVPV EDNDENYIHPTESSSPPPEKAPMVNR | 172 |
| EpoR(339-508) | WGTMQAVEPGTDDEGPLLEPVGSEHAQDTYLV LDKWLLPRNPPSEDLPGPGGSVDIVAMDEGSE ASSCSSALASKPSPEGASAASFEYTILDPSSQLL RPWTLCPELPPTPPHLKYLYLVVSDSGISTDYSS GDSQGAQGGLSDGPYSNPYENSLIPAAEPLPPS YVACS | 173 |
| IL12Rb2(714-862) | VTPVFRHPPCSNWPQREKGIQGHQASEKDMM HSASSPPPPRALQAESRQLVDLYKVLESRGSDP KPENPACPWTVLPAGDLPTHDGYLPSNIDDLPS HEAPLADSLEELEPQHISLSVFPSSSLHPLTFSC GDKLTLDQLKMRCDSLML | 174 |
| IL12Rb1(622-662) | WDKGERTEPLEKTELPEGAPELALDTELSLEDG DRCKAKM | 175 |
| IL10R1(304-578) | VSPELKNLDLHGSTDSGFGSTKPSLQTEEPQFL LPDPHPQADRTLGNREPPVLGDSCSSGSSNST DSGICLQEPSLSPSTGPTWEQQVGSNSRGQDD SGIDLVQNSEGRAGDTQGGSALGHHSPPEPEV PGEEDPAAVAFQGYLRQTRCAEEKATKTGCLE EESPLTDGLGPKFGRCLVDEAGLHPPALAKGYL | 176 |

TABLE 1B-continued

| | KQDPLEMTLASSGAPTGQWNQPTEEWSLLALS SCSDLGISDWSFAHDLAPLGCVAAPGGLLGSFN SDLVTLPLISSLQSSE | |
|---|---|---|
| Other constructs | Amino acid sequence | SEQ ID |
| Myristoyl-Myd88-CD40-FKBP(F36V)x2 (GoCART) | MGSSKSKPKDPSQRMAAGGPGAGSAAPVSST SSLPLAALNMRVRRRLSLFLNVRTQVAADWTAL AEEMDFEYLEIRQLETQADPTGRLLDAWQGRP GASVGRLLELLTKLGRDDVLLELGPSIEEDCQKY ILKQQQEEAEKPLQVAAVDSSVPRTAELAGITTL DDPLGHMPERFDAFICYCPSDIKKVAKKPTNKA PHPKQEPQEINFPDDLPGSNTAAPVQETLHGCQ PVTQEDGKESRISVQERQGVQVETISPGDGRTF PKRGQTCVVHYTGMLEDGKKVDSSRDRNKPFK FMLGKQEVIRGWEEGVAQMSVGQRAKLTISPD YAYGATGHPGIIPPHATLVFDVELLKLGVQVETIS PGDGRTFPKRGQTCVVHYTGMLEDGKKVDSSR DRNKPFKFMLGKQEVIRGWEEGVAQMSVGQR AKLTISPDYAYGATGHPGIIPPHATLVFDVELLKLE | 177 |
| TagBFP | MSELIKENMHMKLYMEGTVDNHHFKCTSEGEG KPYEGTQTMRIKVVEGGPLPFAFDILATSFLYGS KTFINHTQGIPDFFKQSFPEGFTWERVTTYEDG GVLTATQDTSLQDGCLIYNVKIRGVNFTSNGPV MQKKTLGWEAFTETLYPADGGLEGRNDMALKL VGGSHLIANIKTTYRSKKPAKNLKMPGVYYVDY RLERIKEANNETYVEQHEVAVARYCDLPSKLGH KLN | 178 |

Exemplary transmembrane and JAK-binding sequences of, or derived from, TPOR/MPLR useful in the inducible chimeric cytokine receptors provided herein are shown in Table 1C.

TABLE 1C

| Tyrosine kinase activating domain comprising a JAK binding domain and transmembrane domain variants of TPOR | Amino acid sequence | SEQ ID |
|---|---|---|
| PD1(156-191)-TPOR/MPLR (514-582) | PSPSPRPAGQFQTLVVGVVGGLLGSLVLLVWVL AVI RWQFPAHYRRLRHALWPSLPDLHRVLGQYLRD TAALSPPKATVSDTCEEVEPSLLEILPKSSERTPL PL | 104 |
| TPOR/MPLR(478-582) (wildtype sequence) | SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL | 105 |
| TPOR/MPLR(N − 1) | SDPTRVETATETWISLVTALHLVLGLSAVLGLLLL RWQFPAHYRRLRHALWPSLPDLHRVLGQYLRD TAALSPPKATVSDTCEEVEPSLLEILPKSSERTPL PL | 106 |
| TPOR/MPLR(N − 2) | SDPTRVETATETISLVTALHLVLGLSAVLGLLLLR WQFPAHYRRLRHALWPSLPDLHRVLGQYLRDT AALSPPKATVSDTCEEVEPSLLEILPKSSERTPL PL | 107 |
| TPOR/MPLR(N − 2 + 1) | SDPTRVETATETLISLVTALHLVLGLSAVLGLLLL RWQFPAHYRRLRHALWPSLPDLHRVLGQYLRD TAALSPPKATVSDTCEEVEPSLLEILPKSSERTPL PL | 108 |
| TPOR/MPLR(N − 3) | SDPTRVETATETSLVTALHLVLGLSAVLGLLLLR WQFPAHYRRLRHALWPSLPDLHRVLGQYLRDT AALSPPKATVSDTCEEVEPSLLEILPKSSERTPL PL | 109 |

TABLE 1C-continued

| Tyrosine kinase activating domain comprising a JAK binding domain and transmembrane domain variants of TPOR | Amino acid sequence | SEQ ID |
|---|---|---|
| TPOR/MPLR(N − 4) | SDPTRVETATETLVTALHLVLGLSAVLGLLLLRW QFPAHYRRLRHALWPSLPDLHRVLGQYLRDTA ALSPPKATVSDTCEEVEPSLLEILPKSSERTPLPL | 110 |
| TPOR/MPLR(N − 4 + 1) | SDPTRVETATETILVTALHLVLGLSAVLGLLLLRW QFPAHYRRLRHALWPSLPDLHRVLGQYLRDTA ALSPPKATVSDTCEEVEPSLLEILPKSSERTPLPL | 111 |
| TPOR/MPLR(N − 5) | SDPTRVETATETVTALHLVLGLSAVLGLLLLRWQ FPAHYRRLRHALWPSLPDLHRVLGQYLRDTAAL SPPKATVSDTCEEVEPSLLEILPKSSERTPLPL | 112 |
| TPOR/MPLR(N − 6) | SDPTRVETATETTALHLVLGLSAVLGLLLLRWQF PAHYRRLRHALWPSLPDLHRVLGQYLRDTAALS PPKATVSDTCEEVEPSLLEILPKSSERTPLPL | 113 |
| TPOR/MPLR(N − 7) | SDPTRVETATETALHLVLGLSAVLGLLLLRWQFP AHYRRLRHALWPSLPDLHRVLGQYLRDTAALSP PKATVSDTCEEVEPSLLEILPKSSERTPLPL | 114 |
| TPOR/MPLR(N − 8) | SDPTRVETATETLHLVLGLSAVLGLLLLRWQFPA HYRRLRHALWPSLPDLHRVLGQYLRDTAALSPP KATVSDTCEEVEPSLLEILPKSSERTPLPL | 115 |
| TPOR/MPLR(N − 9) | SDPTRVETATETHLVLGLSAVLGLLLLRWQFPA HYRRLRHALWPSLPDLHRVLGQYLRDTAALSPP KATVSDTCEEVEPSLLEILPKSSERTPLPL | 116 |
| TPOR/MPLR(N − 10) | SDPTRVETATETLVLGLSAVLGLLLLRWQFPAHY RRLRHALWPSLPDLHRVLGQYLRDTAALSPPKA TVSDTCEEVEPSLLEILPKSSERTPLPL | 117 |
| TPOR/MPLR(N − 11) | SDPTRVETATETVLGLSAVLGLLLLRWQFPAHY RRLRHALWPSLPDLHRVLGQYLRDTAALSPPKA TVSDTCEEVEPSLLEILPKSSERTPLPL | 118 |
| TPOR/MPLR(N − 12) | SDPTRVETATETLGLSAVLGLLLLRWQFPAHYR RLRHALWPSLPDLHRVLGQYLRDTAALSPPKAT VSDTCEEVEPSLLEILPKSSERTPLPL | 119 |
| TPOR/MPLR(N − 13) | SDPTRVETATETGLSAVLGLLLLRWQFPAHYRR LRHALWPSLPDLHRVLGQYLRDTAALSPPKATV SDTCEEVEPSLLEILPKSSERTPLPL | 120 |
| TPOR/MPLR(N − 14) | SDPTRVETATETLSAVLGLLLLRWQFPAHYRRL RHALWPSLPDLHRVLGQYLRDTAALSPPKATVS DTCEEVEPSLLEILPKSSERTPLPL | 121 |
| TPOR/MPLR(N − 15) | SDPTRVETATETSAVLGLLLLRWQFPAHYRRLR HALWPSLPDLHRVLGQYLRDTAALSPPKATVSD TCEEVEPSLLEILPKSSERTPLPL | 122 |
| TPOR/MPLR(N − 16) | SDPTRVETATETAVLGLLLLRWQFPAHYRRLRH ALWPSLPDLHRVLGQYLRDTAALSPPKATVSDT CEEVEPSLLEILPKSSERTPLPL | 123 |
| TPOR/MPLR(N − 17) | SDPTRVETATETVLGLLLLRWQFPAHYRRLRHA LWPSLPDLHRVLGQYLRDTAALSPPKATVSDTC EEVEPSLLEILPKSSERTPLPL | 124 |
| TPOR/MPLR(N − 18) | SDPTRVETATETLGLLLLRWQFPAHYRRLRHAL WPSLPDLHRVLGQYLRDTAALSPPKATVSDTCE EVEPSLLEILPKSSERTPLPL | 125 |
| TPOR/MPLR(N + 1) | SDPTRVETATETAWLISLVTALHLVLGLSAVLGLL LLRWQFPAHYRRLRHALWPSLPDLHRVLGQYL RDTAALSPPKATVSDTCEEVEPSLLEILPKSSER TPLPL | 126 |
| TPOR/MPLR(N + 2) | SDPTRVETATETAVWLISLVTALHLVLGLSAVLG LLLLRWQFPAHYRRLRHALWPSLPDLHRVLGQY | 127 |

TABLE 1C-continued

| Tyrosine kinase activating domain comprising a JAK binding domain and transmembrane domain variants of TPOR | Amino acid sequence | SEQ ID |
|---|---|---|
| | LRDTAALSPPKATVSDTCEEVEPSLLEILPKSSE RTPLPL | |
| TPOR/MPLR(N + 3) | SDPTRVETATETAWLVLISLVTALHLVLGLSAVL GLLLLRWQFPAHYRRLRHALWPSLPDLHRVLG QYLRDTAALSPPKATVSDTCEEVEPSLLEILPKS SERTPLPL | 128 |
| TPOR/MPLR(N + 4) | SDPTRVETATETAWILVLISLVTALHLVLGLSAVL GLLLLRWQFPAHYRRLRHALWPSLPDLHRVLG QYLRDTAALSPPKATVSDTCEEVEPSLLEILPKS SERTPLPL | 129 |
| TPOR/MPLR(N + 5) | SDPTRVETATETAWLILVLISLVTALHLVLGLSAV LGLLLLRWQFPAHYRRLRHALWPSLPDLHRVLG QYLRDTAALSPPKATVSDTCEEVEPSLLEILPKS SERTPLPL | 130 |
| TPOR/MPLR(N + 6) | SDPTRVETATETAWLLILVLISLVTALHLVLGLSA VLGLLLLRWQFPAHYRRLRHALWPSLPDLHRVL GQYLRDTAALSPPKATVSDTCEEVEPSLLEILPK SSERTPLPL | 131 |
| TPOR/MPLR(N + 7) | SDPTRVETATETAWVLLILVLISLVTALHLVLGLS AVLGLLLLRWQFPAHYRRLRHALWPSLPDLHRV LGQYLRDTAALSPPKATVSDTCEEVEPSLLEILP KSSERTPLPL | 132 |
| TPOR/MPLR(N + 8) | SDPTRVETATETAWLVLLILVLISLVTALHLVLGL SAVLGLLLLRWQFPAHYRRLRHALWPSLPDLHR VLGQYLRDTAALSPPKATVSDTCEEVEPSLLEIL PKSSERTPLPL | 133 |

In another aspect provided herein are isolated immune cells comprising one or more inducible chimeric cytokine receptors disclosed herein. In other embodiments, isolated immune cells provided herein comprise (i) one or more inducible chimeric cytokine receptors disclosed herein and (ii) a chimeric antigen receptor (CAR). Advantageously, the isolated immune cells provided herein exhibit improved persistence upon contact with a ligand that binds to the dimerization domain relative to cells that do not express the inducible chimeric cytokine receptor. In some embodiments, the isolated immune cells provided herein exhibit improved cytotoxicity, increased expansion, and/or increased levels of memory phenotype markers upon contact with a ligand that binds to the dimerization domain relative to cells that do not express the inducible chimeric cytokine receptor. The improvement in persistence, cytotoxicity, expansion, and/or memory phenotype markers exhibited by isolated immune cells comprising inducible chimeric cytokine receptors described herein can be in vitro or in vivo. In some embodiments, isolated immune cell is selected from the group consisting of: T cell, dendritic cell, killer dendritic cell, mast cell, NK-cell, macrophage, monocyte, and B-cell.

In some embodiments, isolated immune cell is an isolated T cell. In some embodiments, isolated T cells provided herein comprise one or more inducible chimeric cytokine receptors disclosed herein. In other embodiments, isolated T cells provided herein comprise (i) one or more inducible chimeric cytokine receptors disclosed herein and (ii) a chimeric antigen receptor (CAR). Advantageously, the isolated T cells provided herein exhibit improved in vivo persistence upon contact with a ligand that binds to the dimerization domain relative to cells that do not express the inducible chimeric cytokine receptor. In some embodiments, the isolated T cells provided herein exhibit improved cytotoxicity, increased expansion, and/or increased levels of memory phenotype markers upon contact with a ligand that binds to the dimerization domain relative to cells that do not express the inducible chimeric cytokine receptor. The improvement in one or more of these features can be in vitro or in vivo.

In some embodiments, the isolated immune cell comprising one or more inducible chimeric cytokine receptors disclosed herein exhibits (i) increased in vivo persistence, (ii) increased STAT activation, (iii) increased cytotoxicity, (iv) increased levels of memory phenotype markers, (v) increased expansion (proliferation), or combinations of these functional features, upon contact with a ligand that binds to the dimerization domain, relative to an isolated immune cell that does not express the inducible chimeric cytokine receptor. In some embodiments, the improvement in the one or more functional features described herein is dose-dependent, i.e., the functional activity of the immune cell comprising the inducible chimeric cytokine receptors increases upon contact with increasing doses of the ligand that binds to the dimerization domain. In some embodiments, STATs activated by the inducible chimeric cytokine receptors include STAT1, STAT2, STAT3, STAT4, STAT5, STAT6, or combinations thereof. Activation of STAT includes recruitment of STAT, phosphoyration of STAT, and/or dimerization of STAT or translocation of STAT. In some embodiments, memory phenotype markers increased or maintained by the immune cell comprising the inducible chimeric cytokine receptor include stem cell memory (Tscm) marker and central memory (Tcm) marker.

In some embodiments, the improvement in one or more functional features exhibited by an immune cell comprising an inducible chimeric cytokine receptor provided herein is at least about 2 fold, 2.5 fold, 3 fold, 3.5 fold, 4 fold, 4.5 fold, 5 fold, 6 fold, 7 fold, 8 fold, 9 fold, 10 fold, 15 fold, 20 fold, 25 fold, 30 fold, 40 fold, 50 fold, 60 fold, 70 fold, 80 fold, 90 fold, 100 fold, 125 fold, 150 fold, 200 fold, 250 fold, 300 fold, 350 fold, 400 fold, 450 fold, or even about 500 fold, including values and ranges therebetween, compared to an immune cell that does not express the inducible chimeric cytokine receptor.

In some embodiments, the improvement in one or more functional features exhibited by an immune cell comprising an inducible chimeric cytokine receptor provided herein is at least about 10%, 20%, 25%, 30%, 35%, 40%, 45%, 50%, 55%, 60%, 70%, 75%, 80%, 90%, 100%, 125%, 150%, 200%, 250%, 300%, 350%, 400%, or even about 500%, including values and ranges therebetween, compared to an immune cell that does not express the inducible chimeric cytokine receptor.

In some embodiments, an isolated immune cell, such as an isolated T cell, of the invention comprises an inducible chimeric cytokine receptor shown in Table 2A.

TABLE 2A

Exemplary inducible chimeric cytokine receptor sequences

| Receptor name | Amino acid sequence | SEQ ID |
|---|---|---|
| CD8 SS-Myc-<br>FKBP(F36V)-<br>EpoR(237-508;<br>L241G, L242P)-V5 | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>WGTMQAVEPGTDDEGPLLEPVGSEHAQDTYLV<br>LDKWLLPRNPPSEDLPGPGGSVDIVAMDEGSE<br>ASSCSSALASKPSPEGASAASFEYTILDPSSQLL<br>RPWTLCPELPPTPPHLKYLYLVVSDSGISTDYSS<br>GDSQGAQGGLSDGPYSNPYENSLIPAAEPLPPS<br>YVACS<br>IPNPLLGLDST | 1 |
| V5-EpoR(273-508)-<br>FKBP(F36V)-<br>FKBP(F36V) | IPNPLLGLDST<br>SHRRALKQKIWPGIPSPESEFEGLFTTHKGNFQ<br>LWLYQNDGCLWWSPCTPFTEDPPASLEVLSER<br>CWGTMQAVEPGTDDEGPLLEPVGSEHAQDTYL<br>VLDKWLLPRNPPSEDLPGPGGSVDIVAMDEGS<br>EASSCSSALASKPSPEGASAASFEYTILDPSSQL<br>LRPWTLCPELPPTPPHLKYLYLVVSDSGISTDYS<br>SGDSQGAQGGLSDGPYSNPYENSLIPAAEPLPP<br>SYVACS<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLGVQVETISPGDGRTFPKRGQTCVV<br>HYTGMLEDGKKVDSSRDRNKPFKFMLGKQEVI<br>RGWEEGVAQMSVGQRAKLTISPDYAYGATGHP<br>GIIPPHATLVFDVELLKLE | 2 |
| V5-EpoR(273-508)-<br>FKBP(E31G, 36V, R71G,<br>K105E)-<br>FKBP(E31G, 36V, R71G,<br>K105E) | IPNPLLGLDST<br>SHRRALKQKIWPGIPSPESEFEGLFTTHKGNFQ<br>LWLYQNDGCLWWSPCTPFTEDPPASLEVLSER<br>CWGTMQAVEPGTDDEGPLLEPVGSEHAQDTYL<br>VLDKWLLPRNPPSEDLPGPGGSVDIVAMDEGS<br>EASSCSSALASKPSPEGASAASFEYTILDPSSQL<br>LRPWTLCPELPPTPPHLKYLYLVVSDSGISTDYS<br>SGDSQGAQGGLSDGPYSNPYENSLIPAAEPLPP<br>SYVACS<br>MGVQVETISPGDGRTFPKRGQTCVVHYTGMLG<br>DGKKVDSSRDRNKPFKFMLGKQEVIRGWEEGV<br>AQMSVGQGAKLTISPDYAYGATGHPGIIPPHATL<br>VFDVELLELGVQVETISPGDGRTFPKRGQTCVV<br>HYTGMLGDGKKVDSSRDRNKPFKFMLGKQEVI<br>RGWEEGVAQMSVGQGAKLTISPDYAYGATGHP<br>GIIPPHATLVFDVELLELE | 3 |
| CD8 SS-Myc-<br>FKBP(F36V)-<br>EpoR(237-338;<br>L241G, L242P)-<br>GHR(353-638) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL | 4 |

TABLE 2A-continued

Exemplary inducible chimeric cytokine receptor sequences

| Receptor name | Amino acid sequence | SEQ ID |
|---|---|---|
| | VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>PDEKTEESDTDRLLSSDHEKSHSNLGVKDGDS<br>GRTSCCEPDILETDFNANDIHEGTSEVAQPQRL<br>KGEADLLCLDQKNQNNSPYHDACPATQQPSVI<br>QAEKNKPQPLPTEGAESTHQAAHIQLSNPSSLS<br>NIDFYAQVSDITPAGSVVLSPGQKNKAGMSQCD<br>MHPEMVSLCQENFLMDNAYFCEADAKKCIPVAP<br>HIKVESHIQPSLNQEDIYITTESLTTAAGRPGTGE<br>HVPGSEMPVPDYTSIHIVQSPQGLILNATALPLP<br>DKEFLSSCGYVSTDQLNKIMP | |
| CD8 SS-Myc-<br>FKBP(F36V)-<br>EpoR(237-338;<br>L241G, L242P)-<br>IL2Rb(333-551) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VTQLLLQQDKVPEPASLSSNHSLTSCFTNQGYF<br>FFHLPDALEIEACQVYFTYDPYSEEDPDEGVAG<br>APTGSSPQPLQPLSGEDDAYCTFPSRDDLLLFS<br>PSLLGGPSPPSTAPGGSGAGEERMPPSLQERV<br>PRDWDPQPLGPPTPGVPDLVDFQPPPELVLRE<br>AGEEVPDAGPREGVSFPWSRPPGQGEFRALNA<br>RLPLNTDAYLSLQELQGQDPTHLV | 5 |
| CD8 SS-Myc-<br>FKBP(F36V)-<br>EpoR(237-338;<br>L241G, L242P)-<br>IL7R(316-459) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ | 6 |
| CD8 SS-Myc-<br>FKBP(F36V)-<br>EpoR(237-338;<br>L241G, L242P)-<br>IL12Rb2(714-862) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VTPVFRHPPCSNWPQREKGIQGHQASEKDMM<br>HSASSPPPPRALQAESRQLVDLYKVLESRGSDP<br>KPENPACPWTVLPAGDLPTHDGYLPSNIDDLPS<br>HEAPLADSLEELEPQHISLSVFPSSSLHPLTFSC<br>GDKLTLDQLKMRCDSLML | 7 |
| CD8 SS-Myc-<br>FKBP(F36V)-<br>EpoR(237-338;<br>L241G, L242P)-<br>IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>SDPKPENPACPWTVLPAGDLPTHDGYLPSNIDD<br>LPSHEAPLADSLEELEPQ | 8 |
| CD8 SS-Myc-<br>FKBP(F36V)- | MALPVTALLLPLALLLHAARP<br>EQKLISEEDL | 9 |

TABLE 2A-continued

Exemplary inducible chimeric cytokine receptor sequences

| Receptor name | Amino acid sequence | SEQ ID |
|---|---|---|
| EpoR(237-338; L241G, L242P)- IL21R(322-538) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVVIPPPLSSPGPQAS | |
| CD8 SS-Myc- FKBP(F36V)- EpoR(237-338; L241G, L242P)- IFNAR2(310-515) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC KKKVWDYNYDDESDSDTEAAPRTSGGGYTMH GLTVRPLGQASATSTESQLIDPESEEEPDLPEVD VELPTMPKDSPQQLELLSGPCERRKSPLQDPFP EEDYSSTEGSGGRITFNVDLNSVFLRVLDDEDS DDLEAPLMLSSHLEEMVDPEDPDNVQSNHLLAS GEGTQPTFPSPSSEGLWSEDAPSDQSDTSESD VDLGDGYIMR | 10 |
| CD8 SS-Myc- FKBP(F36V)- EpoR(237-338; L241G, L242P)- IFNAR1(300-520) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC RGVRPTPRVRAPATQQTRWKKDLAEDEEEEDE EDTEDGVSFQPYIEPPSFLGQEHQAPGHSEAG GVDSGRPRAPLVPSEGSSAWDSSDRSWASTV DSSWDRAGSSGYLAEKGPGQGPGGDGHQESL PPPEFSKDSGFLEELPEDNLSSWATWGTLPPEP NLVPGGPPVSLQTLTFCWESSPEEEEAREREI EDSDAGSWGAESTQRTEDRGRTLGHYMAR | 11 |
| CD8 SS-Myc- FKBP(F36V)- muEpoR(236-337; L264G, L265P)- muIL2Rb(337-539) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPASLLTASDLDPLILTLSLILVLISLGPTVLALLS HRRTLQQKIWPGIPSPESEFEGLFTTHKGNFQL WLLQRDGCLWWSPGSSFPEDPPAHLEVLSEPR AVQLLLLQKDSAPLPSPSGHSQASCFTNQGYFF FHLPNALEIESCQVYFTYDPCVEEEVEEDGSRL PEGSPHPPLLPLAGEQDDYCAFPPRDDLLLFSP SLSTPNTAYGGSRAPEERSPLSLHEGLPSLASR DLMGLQRPLERMPEGDGEGLSANSSGEQASVP EGNLHGQDQDRGQGPILTLNTDAYLSLQELQAQ DSVHLI | 12 |
| CD8 SS-Myc- FKBP(F36V)- muEpoR(236-337; L264G, L265P)- muIL7R(316-459) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPASLLTASDLDPLILTLSLILVLISLGPTVLALLS HRRTLQQKIWPGIPSPESEFEGLFTTHKGNFQL WLLQRDGCLWWSPGSSFPEDPPAHLEVLSEPR | 13 |

TABLE 2A-continued

Exemplary inducible chimeric cytokine receptor sequences

| Receptor name | Amino acid sequence | SEQ ID |
|---|---|---|
| | ARDEVESFLPNDLPAQPEELETQGHRAAVHSAN<br>RSPETSVSPPETVRRESPLRCLARNLSTCNAPP<br>LLSSRSPDYRDGDRNRPPVYQDLLPNSGNTNV<br>PVPVPQPLPFQSGILIPVSQRQPISTSSVLNQEE<br>AYVTMSSFYQNK | |
| CD8 SS-Myc-<br>FKBP(F36V)-<br>EpoR(237-338;<br>L241G, L242P)-<br>IL7R(316-459)-<br>IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 14 |
| CD8 SS-Myc-<br>FKBP(F36V)-<br>GP130(609-700)-<br>IL7R(316-459)-<br>IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>TTPKFAQGEIEAIVVPVCLAFLLTTLLGVLFCNK<br>RDLIKKHIWPNVPDPSKSHIAQWSPHTPPRHNF<br>NSKDQMYSDGNFTDVSVVEIEAND<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 15 |
| CD8 SS-Myc-<br>FKBP(F36V)-PrIR(221-319)-<br>IL7R(316-459)-<br>IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>ATFIQIPSDFTMNDTTVWISVAVLSAVICLIIVWAV<br>ALKGYSMVTCIFPPVPGPKIKGFDAHLLEKGKSE<br>ELLSALGCQDFPPTSDYEDLLVEYLEVDD<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 16 |
| CD8 SS-Myc-<br>FKBP(F36V)-GHR(251-352)-<br>IL7R(316-459)-<br>IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>LPQMSQFTCEEDFYFPWLLIIIFGIFGLTVMLFVF<br>LFSKQQRIKMLILPPVPVPKIKGIDPDLLKEGKLE<br>EVNTILAIHDSYKPEFHSDDSWVEFIELDIDE<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 17 |

TABLE 2A-continued

Exemplary inducible chimeric cytokine receptor sequences

| Receptor name | Amino acid sequence | SEQ ID |
|---|---|---|
| CD8 SS-Myc-FKBP(F36V)-GCSFR(614-710)-IL7R(316-459)-IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>LTLMTLTPEGSELHIILGLFGLLLLLTCLCGTAWL<br>CCSPNRKNPLWPSVPDPAHSSLGSWVPTIMEE<br>DAFQLPGLGTPPITKLTVLEEDEKKPVPWE<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 18 |
| CD8 SS-Myc-FKBP(F36V)-TPOR/MPLR(478-582)-IL7R(316-459)-IL12Rb2(775-825) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 19 |
| CD8 SS-Myc-FKBP(F36V)-EpoR(237-338; L241G, L242P)-IL7R(376-416) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ACDAPILSSSRSLDCRESGKNGPHVYQDLLLSL<br>GTTNSTLP | 20 |
| CD8 SS-Myc-FKBP(F36V)-EpoR(237-338; L241G, L242P)-IL7R(424-459) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>GILTLNPVAQGQPILTSLGSNQEEAYVTMSSFYQ<br>NQ | 21 |
| CD8 SS-Myc-FKBP(F36V)-EpoR(237-338; L241G, L242P)-IL7R(376-416, 424-459) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ACDAPILSSSRSLDCRESGKNGPHVYQDLLLSL<br>GTTNSTLPQGQPILTSLGSNQEEAYVTMSSFYQ<br>NQ | 22 |
| CD8 SS-Myc-FKBP(F36V)- | MALPVTALLLPLALLLHAARP<br>EQKLISEEDL | 23 |

TABLE 2A-continued

Exemplary inducible chimeric cytokine receptor sequences

| Receptor name | Amino acid sequence | SEQ ID |
|---|---|---|
| EpoR(237-338; L241G, L242P)- IL7R(424-459; Y456F) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC GILTLNPVAQGQPILTSLGSNQEEAYVTMSSFFQ NQ | |
| CD8 SS-Myc- FKBP(F36V)- EpoR(237-338; L241G, L242P)- IL7R(376-416, 424-459; Y456F) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC ACDAPILSSSRSLDCRESGKNGPHVYQDLLLSL GTTNSTLPQGQPILTSLGSNQEEAYVTMSSFFQ NQ | 24 |
| CD8 SS-Myc- FKBP(F36V)- EpoR(237-338; L241G, L242P)- IL2Rb(393-433) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC DEGVAGAPTGSSPQPLQPLSGEDDAYCTFPSR DDLLLFSPS | 25 |
| CD8 SS-Myc- FKBP(F36V)- EpoR(237-338; L241G, L242P)- IL2Rb(518-551) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC GQGEFRALNARLPLNTDAYLSLQELQGQDPTHLV | 26 |
| CD8 SS-Myc- FKBP(F36V)- EpoR(237-338; L241G, L242P)- IL2Rb(339-379, 393-433) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC QQDKVPEPASLSSNHSLTSCFTNQGYFFFHLPD ALEIEACQDEGVAGAPTGSSPQPLQPLSGEDDA YCTFPSRDDLLLFSPS | 27 |
| CD8 SS-Myc- FKBP(F36V)- EpoR(237-338; L241G, L242P)- IL2Rb(339-379, 518-551) | MALPVTALLLPLALLLHAARP EQKLISEEDL MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC QQDKVPEPASLSSNHSLTSCFTNQGYFFFHLPD ALEIEACQ GQGEFRALNARLPLNTDAYLSLQELQGQDPTHLV | 28 |
| CD8 SS-Myc- FKBP(F36V)- EpoR(237-338; | MALPVTALLLPLALLLHAARP EQKLISEEDL MGVQVETISPGDGRTFPKRGQTCVVHYTGMLE | 29 |

TABLE 2A-continued

Exemplary inducible chimeric cytokine receptor sequences

| Receptor name | Amino acid sequence | SEQ ID |
|---|---|---|
| L241G, L242P)-<br>IL2Rb(393-433, 518-551) | DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>DEGVAGAPTGSSPQPLQPLSGEDDAYCTFPSR<br>DDLLLFSPSGQGEFRALNARLPLNTDAYLSLQEL<br>QGQDPTHLV | |
| CD8 SS-Myc-<br>FKBP(F36V)-<br>EpoR(237-338;<br>L241G, L242P)-<br>IL2Rb(339-379, 393-433, 518-551) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>QQDKVPEPASLSSNHSLTSCFTNQGYFFFHLPD<br>ALEIEACQDEGVAGAPTGSSPQPLQPLSGEDDA<br>YCTFPSRDDLLLFSPSGQGEFRALNARLPLNTD<br>AYLSLQELQGQDPTHLV | 30 |
| CD8 SS-Myc-<br>FKBP(F36V)-<br>EpoR(237-338;<br>L241G, L242P)-<br>EGFR(955-1186) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VIQGDERMHLPSPTDSNFYRALMDEEDMDDVV<br>DADEYLIPQQGFFSSPSTSRTPLLSSLSATSNNS<br>TVACIDRNGLQSCPIKEDSFLQRYSSDPTGALTE<br>DSIDDTFLPVPEYINQSVPKRPAGSVQNPVYHN<br>QPLNPAPSRDPHYQDPHSTAVGNPEYLNTVQP<br>TCVNSTFDSPAHWAQKGSHQISLDNPDYQQDF<br>FPKEAKPNGIFKGSTAENAEYLRVAPQSSEFIGA | 31 |
| CD8 SS-Myc-<br>FKBP(F36V)-<br>EpoR(237-338;<br>L241G, L242P)-<br>EGFR(955-1044, 1058-1186;<br>Y974F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VIQGDERMHLPSPTDSNFFRALMDEEDMDDVV<br>DADEYLIPQQGFFSSPSTSRTPLLSSLSATSNNS<br>TVACIDRNGLQSCPIKEDSFLQRIDDTFLPVPEYI<br>NQSVPKRPAGSVQNPVYHNQPLNPAPSRDPHY<br>QDPHSTAVGNPEYLNTVQPTCVNSTFDSPAHW<br>AQKGSHQISLDNPDYQQDFFPKEAKPNGIFKGS<br>TAENAEYLRVAPQSSEFIGA | 32 |
| CD8 SS-Myc-<br>FKBP(F36V)-<br>EpoR(237-338;<br>L241G, L242P)-<br>EGFR(955-1009;<br>Y974F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VIQGDERMHLPSPTDSNFFRALMDEEDMDDVV<br>DADEYLIPQQGFFSSPSTSRTP | 33 |
| CD8 SS-Myc-<br>FKBP(F36V)-<br>EpoR(237-338;<br>L241G, L242P)-<br>EGFR(1019-1085) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL | 34 |

TABLE 2A-continued

Exemplary inducible chimeric cytokine receptor sequences

| Receptor name | Amino acid sequence | SEQ ID |
|---|---|---|
| | VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>NNSTVACIDRNGLQSCPIKEDSFLQRIDDTFLPV<br>PEYINQSVPKRPAGSVQNPV | |
| CD8 SS-Myc-<br>FKBP(F36V)-<br>EpoR(237-338;<br>L241G, L242P)-<br>EGFR(1037-1044,<br>1058-1103;<br>Y1068/1101F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>KEDSFLQRIDDTFLPVPEFINQSVPKRPAGSVQN<br>PVYHNQPLNPAPSRDPHFQD | 35 |
| CD8 SS-Myc-<br>FKBP(F36V)-<br>EpoR(237-338;<br>L241G, L242P)-<br>EGFR(1066-1118;<br>Y1068/1086F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VPEFINQSVPKRPAGSVQNPVFHNQPLNPAPSR<br>DPHYQDPHSTAVGNPEYLNTV | 36 |
| CD8 SS-Myc-<br>FKBP(F36V)-<br>EpoR(237-338;<br>L241G, L242P)-<br>EGFR(1122-1165) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>PEYLNTVQPTCVNSTFDSPAHWAQKGSHQISLD<br>NPDYQQDFFPKEAKPNGIFKG | 37 |
| CD8 SS-Myc-<br>FKBP(F36V)-<br>EpoR(237-338;<br>L241G, L242P)-<br>EGFR(1133-1186;<br>Y1148F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>WAQKGSHQISLDNPDFQQDFFPKEAKPNGIFKG<br>STAENAEYLRVAPQSSEFIGA | 38 |
| CD8 SS-Myc-<br>FKBP(F36V)-<br>EpoR(237-338;<br>L241G, L242P)-<br>BLNK(53-208) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ASESPADEEEQWSDDFDSDYENPDEHSDSEMY<br>VMPAEENADDSYEPPPVEQETRPVHPALPFAR<br>GEYIDNRSSQRHSPPFSKTLPSKPSWPSEKARL<br>TSTLPALTALQKPQVPPKPKGLLEDEADYVVPV<br>EDNDENYIHPTESSSPPPEKAPMVNR | 39 |
| CD8 SS-Myc-<br>FKBP(F36V)-<br>EpoR(237-338;<br>L241G, L242P)-<br>BLNK(53-208; Y72F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL | 40 |

TABLE 2A-continued

Exemplary inducible chimeric cytokine receptor sequences

| Receptor name | Amino acid sequence | SEQ ID |
|---|---|---|
| | VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ASESPADEEEQWSDDFDSDFENPDEHSDSEMY<br>VMPAEENADDSYEPPPVEQETRPVHPALPFAR<br>GEYIDNRSSQRHSPPFSKTLPSKPSWPSEKARL<br>TSTLPALTALQKPQVPPKPKGLLEDEADYVVPV<br>EDNDENYIHPTESSSPPPEKAPMVNR | |
| CD8 SS-Myc-<br>FKBP(F36V)-<br>EpoR(237-338;<br>L241G, L242P)-<br>BLNK(53-208;<br>Y72F, Y96F) | MALPVTALLLPLALLLHAARP<br>EQKLISEEDL<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ASESPADEEEQWSDDFDSDFENPDEHSDSEMY<br>VMPAEENADDSFEPPPVEQETRPVHPALPFAR<br>GEYIDNRSSQRHSPPFSKTLPSKPSWPSEKARL<br>TSTLPALTALQKPQVPPKPKGLLEDEADYVVPV<br>EDNDENYIHPTESSSPPPEKAPMVNR | 41 |
| CD8 SS-FKBP(F36V)-<br>TPOR/MPLR(478-582)-<br>IL7R(316-459) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ | 42 |
| CD8 SS-FKBP(F36V)-<br>TPOR/MPLR(478-582)-<br>IL2Rb(333-551) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>VTQLLLQQDKVPEPASLSSNHSLTSCFTNQGYF<br>FFHLPDALEIEACQVYFTYDPYSEEDPDEGVAG<br>APTGSSPQPLQPLSGEDDAYCTFPSRDDLLLFS<br>PSLLGGPSPPSTAPGGSGAGEERMPPSLQERV<br>PRDWDPQPLGPPTPGVPDLVDFQPPPELVLRE<br>AGEEVPDAGPREGVSFPWSRPPGQGEFRALNA<br>RLPLNTDAYLSLQELQGQDPTHLV | 43 |
| CD8 SS-FKBP(F36V)-<br>TPOR/MPLR(478-582)-<br>IL2Rbsmall(393-433,<br>518-551) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>DEGVAGAPTGSSPQPLQPLSGEDDAYCTFPSR<br>DDLLLFSPSGQGEFRALNARLPLNTDAYLSLQEL<br>QGQDPTHLV | 44 |
| CD8 SS-FKBP(F36V)-<br>TPOR/MPLR(478-582)-<br>IL2Rbsmall(339-379,<br>393-433, 518-551) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE | 45 |

TABLE 2A-continued

Exemplary inducible chimeric cytokine receptor sequences

| Receptor name | Amino acid sequence | SEQ ID |
|---|---|---|
| | SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>QQDKVPEPASLSSNHSLTSCFTNQGYFFFHLPD<br>ALEIEACQDEGVAGAPTGSSPQPLQPLSGEDDA<br>YCTFPSRDDLLLFSPSGQGEFRALNARLPLNTD<br>AYLSLQELQGQDPTHLV | |
| CD8 SS-FKBP(F36V)-<br>TPOR/MPLR(478-582)-<br>IL7R(316-459)-<br>IL12Rb2(775-825) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 46 |
| CD8 SS-FKBP(F36V)-<br>TPOR/MPLR(478-582)-<br>IL7R(316-459)-<br>IL21R(322-538) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS | 47 |
| CD8 SS-FKBP(F36V)-<br>TPOR/MPLR(478-582)-<br>IL21R(322-538)-<br>IL7R(316-459) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ | 48 |
| CD8 SS-FKBP(F36V)-<br>TPOR/MPLR(478-582)-<br>IL2Rbsmall(393-433,<br>518-551)-<br>IL21R(322-538) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE | 49 |

TABLE 2A-continued

Exemplary inducible chimeric cytokine receptor sequences

| Receptor name | Amino acid sequence | SEQ ID |
|---|---|---|
| | SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>DEGVAGAPTGSSPQPLQPLSGEDDAYCTFPSR<br>DDLLLFSPSGQGEFRALNARLPLNTDAYLSLQEL<br>QGQDPTHLV<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS | |
| CD8 SS-FKBP(F36V)-<br>TPOR/MPLR(478-582)-<br>IL21R(322-538)-<br>IL2Rbsmall(393-433,<br>518-551) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS<br>DEGVAGAPTGSSPQPLQPLSGEDDAYCTFPSR<br>DDLLLFSPSGQGEFRALNARLPLNTDAYLSLQEL<br>QGQDPTHLV | 50 |
| CD8 SS-FKBP(F36V)-<br>TPOR/MPLR(478-582)-<br>IL2Rbsmall(339-379,<br>393-433, 518-551)-<br>IL21R(322-538) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>QQDKVPEPASLSSNHSLTSCFTNQGYFFFHLPD<br>ALEIEACQDEGVAGAPTGSSPQPLQPLSGEDDA<br>YCTFPSRDDLLLFSPSGQGEFRALNARLPLNTD<br>AYLSLQELQGQDPTHLV<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS | 51 |
| CD8 SS-FKBP(F36V)-<br>TPOR/MPLR(478-582)-<br>IL21R(322-538)-<br>IL2Rbsmall(339-379,<br>393-433, 518-551) | MALPVTALLLPLALLLHAARP<br>MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SDPTRVETATETAWISLVTALHLVLGLSAVLGLLL<br>LRWQFPAHYRRLRHALWPSLPDLHRVLGQYLR<br>DTAALSPPKATVSDTCEEVEPSLLEILPKSSERT<br>PLPL<br>PRSPAKRLQLTELQEPAELVESDGVPKPSFWPT<br>AQNSGGSAYSEERDRPYGLVSIDTVTVLDAEGP<br>CTWPCSCEDDGYPALDLDAGLEPSPGLEDPLL<br>DAGTTVLSCGCVSAGSPGLGGPLGSLLDRLKPP<br>LADGEDWAGGLPWGGRSPGGVSESEAGSPLA<br>GLDMDTFDSGFVGSDCSSPVECDFTSPGDEGP<br>PRSYLRQWVVIPPPLSSPGPQAS<br>QQDKVPEPASLSSNHSLTSCFTNQGYFFFHLPD<br>ALEIEACQDEGVAGAPTGSSPQPLQPLSGEDDA | 52 |

TABLE 2A-continued

Exemplary inducible chimeric cytokine receptor sequences

| Receptor name | Amino acid sequence | SEQ ID |
|---|---|---|
| | YCTFPSRDDLLLFSPSGQGEFRALNARLPLNTD AYLSLQELQGQDPTHLV | |
| CD8 SS-FKBP(F36V)-TPOR/MPLR(478-582)-IL2Rbsmall(393-433, 518-551)-IL7R(316-459) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL DEGVAGAPTGSSPQPLQPLSGEDDAYCTFPSR DDLLLFSPSGQGEFRALNARLPLNTDAYLSLQEL QGQDPTHLV ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 53 |
| CD8 SS-FKBP(F36V)-TPOR/MPLR(478-582)-IL7R(316-459)-IL2Rbsmall(393-433, 518-551) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ DEGVAGAPTGSSPQPLQPLSGEDDAYCTFPSR DDLLLFSPSGQGEFRALNARLPLNTDAYLSLQEL QGQDPTHLV | 54 |
| CD8 SS-FKBP(F36V)-TPOR/MPLR(478-582)-IL2Rbsmall(339-379, 393-433, 518-551)-IL7R(316-459) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 55 |
| CD8 SS-FKBP(F36V)-TPOR/MPLR(478-582)-IL7R(316-459)-IL2Rbsmall(339-379, 393-433, 518-551) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ QQDKVPEPASLSSNHSLTSCFTNQGYFFFHLPD ALEIEACQDEGVAGAPTGSSPQPLQPLSGEDDA | 56 |

TABLE 2A-continued

Exemplary inducible chimeric cytokine receptor sequences

| Receptor name | Amino acid sequence | SEQ ID |
|---|---|---|
| | YCTFPSRDDLLLFSPSGQGEFRALNARLPLNTD AYLSLQELQGQDPTHLV | |
| CD8 SS-FKBP(F36V)-PD1(156-191)-TPOR/MPLR(514-582)-IL7R(316-459)-IL12Rb2(775-825) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE PSPSPRPAGQFQTLVVGVVGGLLGSLVLLVWVL AVI RWQFPAHYRRLRHALWPSLPDLHRVLGQYLRD TAALSPPKATVSDTCEEVEPSLLEILPKSSERTPL PL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ SDPKPENPACPWTVLPAGDLPTHDGYLPSNIDD LPSHEAPLADSLEELEPQ | 57 |
| CD8 SS-FKBP(F36V)-TPOR/MPLR(478-582)-EGFR(1122-1165) | MALPVTALLLPLALLLHAARP MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL PEYLNTVQPTCVNSTFDSPAHWAQKGSHQISLD NPDYQQDFFPKEAKPNGIFKG | 58 |
| CD8 SS-FKBP(F36V)-TPOR/MPLR(478-582)-IL7R(316-459)-IL12Rb2(775-825) FKBP switch containing wildtype TpoR TM sequence | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWISLVTALHLVLGLSAVLGLLLLR WQFPAHYRRLRHALWPSLPDLHRVLGQYLRDTAAL SPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 187 |
| CD8 SS-FKBP(F36V)-TPOR/MPLR(478-582; N-1)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETWISLVTALHLVLGLSAVLGLLLLRW QFPAHYRRLRHALWPSLPDLHRVLGQYLRDTAALSP PKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 188 |
| CD8 SS-FKBP(F36V)-TPOR/MPLR(478-582; N-2)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETISLVTALHLVLGLSAVLGLLLLRWQF PAHYRRLRHALWPSLPDLHRVLGQYLRDTAALSPPK ATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 189 |

TABLE 2A-continued

Exemplary inducible chimeric cytokine receptor sequences

| Receptor name | Amino acid sequence | SEQ ID |
|---|---|---|
| CD8 SS-FKBP(F36V)-TPOR/MPLR(478-582; N − 2 + 1)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLISLVTALHLVLGLSAVLGLLLLRWQ FPAHYRRLRHALWPSLPDLHRVLGQYLRDTAALSPP KATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 190 |
| CD8 SS-FKBP(F36V)-TPOR/MPLR(478-582; N − 3)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETSLVTALHLVLGLSAVLGLLLLRWQF PAHYRRLRHALWPSLPDLHRVLGQYLRDTAALSPPK ATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 191 |
| CD8 SS-FKBP(F36V)-TPOR/MPLR(478-582; N − 4)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLVTALHLVLGLSAVLGLLLLRWQFP AHYRRLRHALWPSLPDLHRVLGQYLRDTAALSPPKA TVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 192 |
| CD8 SS-FKBP(F36V)-TPOR/MPLR(478-582; N − 4 + 1)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETILVTALHLVLGLSAVLGLLLLRWQFP AHYRRLRHALWPSLPDLHRVLGQYLRDTAALSPPKA TVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 193 |
| CD8 SS-FKBP(F36V)-TPOR/MPLR(478-582; N − 5)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETVTALHLVLGLSAVLGLLLLRWQFPA HYRRLRHALWPSLPDLHRVLGQYLRDTAALSPPKAT VSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 194 |
| CD8 SS-FKBP(F36V)-TPOR/MPLR(478-582; N − 6)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETTALHLVLGLSAVLGLLLLRWQFPAH | 195 |

TABLE 2A-continued

Exemplary inducible chimeric cytokine receptor sequences

| Receptor name | Amino acid sequence | SEQ ID |
|---|---|---|
| | YRRLRHALWPSLPDLHRVLGQYLRDTAALSPPKATV SDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | |
| CD8 SS-FKBP(F36V)-TPOR/MPLR(478-582; N-7)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETALHLVLGLSAVLGLLLLRWQFPAHY RRLRHALWPSLPDLHRVLGQYLRDTAALSPPKATVS DTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 196 |
| CD8 SS-FKBP(F36V)-TPOR/MPLR(478-582; N-8)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLHLVLGLSAVLGLLLLRWQFPAHYR RLRHALWPSLPDLHRVLGQYLRDTAALSPPKATVSD TCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 197 |
| CD8 SS-FKBP(F36V)-TPOR/MPLR(478-582; N-9)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETHLVLGLSAVLGLLLLRWQFPAHYR RLRHALWPSLPDLHRVLGQYLRDTAALSPPKATVSD TCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 198 |
| CD8 SS-FKBP(F36V)-TPOR/MPLR(478-582; N-10)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLVLGLSAVLGLLLLRWQFPAHYRRL RHALWPSLPDLHRVLGQYLRDTAALSPPKATVSDTC EEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 199 |
| CD8 SS-FKBP(F36V)-TPOR/MPLR(478-582; N-11)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETVLGLSAVLGLLLLRWQFPAHYRRL RHALWPSLPDLHRVLGQYLRDTAALSPPKATVSDTC EEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS | 200 |

TABLE 2A-continued

Exemplary inducible chimeric cytokine receptor sequences

| Receptor name | Amino acid sequence | SEQ ID |
|---|---|---|
| | GILTLNPVAQGQPILTSLGSNQEEAYVTMSSFYQNQ SDPKPENPACPWTVLPAGDLPTHDGYLPSNIDDLPS HEAPLADSLEELEPQ | |
| CD8 SS-FKBP(F36V)-TPOR/MPLR(478-582; N-12)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLGLSAVLGLLLLRWQFPAHYRRLR HALWPSLPDLHRVLGQYLRDTAALSPPKATVSDTCE EVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 201 |
| CD8 SS-FKBP(F36V)-TPOR/MPLR(478-582; N-13)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLGLSAVLGLLLLRWQFPAHYRRLRH ALWPSLPDLHRVLGQYLRDTAALSPPKATVSDTCEE VEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 202 |
| CD8 SS-FKBP(F36V)-TPOR/MPLR(478-582; N-14)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLSAVLGLLLLRWQFPAHYRRLRHA LWPSLPDLHRVLGQYLRDTAALSPPKATVSDTCEEV EPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 203 |
| CD8 SS-FKBP(F36V)-TPOR/MPLR(478-582; N-15)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETSAVLGLLLLRWQFPAHYRRLRHAL WPSLPDLHRVLGQYLRDTAALSPPKATVSDTCEEVE PSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 204 |
| CD8 SS-FKBP(F36V)-TPOR/MPLR(478-582; N-16)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAVLGLLLLRWQFPAHYRRLRHALW PSLPDLHRVLGQYLRDTAALSPPKATVSDTCEEVEP SLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 205 |

TABLE 2A-continued

Exemplary inducible chimeric cytokine receptor sequences

| Receptor name | Amino acid sequence | SEQ ID |
|---|---|---|
| CD8 SS-FKBP(F36V)-TPOR/MPLR(478-582; N - 17)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETVLGLLLLRWQFPAHYRRLRHALWP SLPDLHRVLGQYLRDTAALSPPKATVSDTCEEVEPS LLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 206 |
| CD8 SS-FKBP(F36V)-TPOR/MPLR(478-582; N - 18)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLGLLLLRWQFPAHYRRLRHALWPS LPDLHRVLGQYLRDTAALSPPKATVSDTCEEVEPSLL EILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 207 |
| CD8 SS-FKBP(F36V)-TPOR/MPLR(478-582; N + 1)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLISLVTALHLVLGLSAVLGLLLLR WQFPAHYRRLRHALWPSLPDLHRVLGQYLRDTAAL SPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 208 |
| CD8 SS-FKBP(F36V)-TPOR/MPLR(478-582; N + 2)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWVLISLVTALHLVLGLSAVLGLLLL RWQFPAHYRRLRHALWPSLPDLHRVLGQYLRDTAA LSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 209 |
| CD8 SS-FKBP(F36V)-TPOR/MPLR(478-582; N + 3)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLVLISLVTALHLVLGLSAVLGLLL LRWQFPAHYRRLRHALWPSLPDLHRVLGQYLRDTA ALSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 210 |
| CD8 SS-FKBP(F36V)-TPOR/MPLR(478-582; N + 4)-IL7R(316-459)-IL12Rb2(775-825) | MALPVTALLLPLALLLHAARP MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE | 211 |

TABLE 2A-continued

Exemplary inducible chimeric cytokine receptor sequences

| Receptor name | Amino acid sequence | SEQ ID |
|---|---|---|
| | SDPTRVETATETAWILVLISLVTALHLVLGLSAVLGLL<br>LLRWQFPAHYRRLRHALWPSLPDLHRVLGQYLRDT<br>AALSPPKATVSDTCEEVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | |
| CD8 SS-FKBP(F36V)-<br>TPOR/MPLR(478-582;<br>N + 5)-IL7R(316-459)-<br>IL12Rb2(775-825) | MALPVTALLLPLALLLHAARP<br>MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETAWLILVLISLVTALHLVLGLSAVLGL<br>LLLRWQFPAHYRRLRHALWPSLPDLHRVLGQYLRD<br>TAALSPPKATVSDTCEEVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 212 |
| CD8 SS-FKBP(F36V)-<br>TPOR/MPLR(478-582;<br>N + 6)-IL7R(316-459)-<br>IL12Rb2(775-825) | MALPVTALLLPLALLLHAARP<br>MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETAWLLILVLISLVTALHLVLGLSAVLG<br>LLLLRWQFPAHYRRLRHALWPSLPDLHRVLGQYLRD<br>TAALSPPKATVSDTCEEVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 213 |
| CD8 SS-FKBP(F36V)-<br>TPOR/MPLR(478-582;<br>N + 7)-IL7R(316-459)-<br>IL12Rb2(775-825) | MALPVTALLLPLALLLHAARP<br>MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETAWVLLILVLISLVTALHLVLGLSAVL<br>GLLLLRWQFPAHYRRLRHALWPSLPDLHRVLGQYL<br>RDTAALSPPKATVSDTCEEVEPSLLEILPKSSERTPL<br>PL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 214 |
| CD8 SS-FKBP(F36V)-<br>TPOR/MPLR(478-582;<br>N + 7)-IL7R(316-459)-<br>IL12Rb2(775-825) | MALPVTALLLPLALLLHAARP<br>MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETAWLVLLILVLISLVTALHLVLGLSAVL<br>GLLLLRWQFPAHYRRLRHALWPSLPDLHRVLGQYL<br>RDTAALSPPKATVSDTCEEVEPSLLEILPKSSERTPL<br>PL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 215 |

In some embodiments, an isolated immune cell, such as an isolated T cell, of the invention comprises an inducible chimeric cytokine receptor shown in Table 2B.

TABLE 2B

Exemplary inducible chimeric cytokine receptor sequences

| Receptor name | Amino acid sequence | SEQ ID |
|---|---|---|
| FKBP(F36V)-EpoR(237-508; L241G, L242P) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC WGTMQAVEPGTDDEGPLLEPVGSEHAQDTYLV LDKWLLPRNPPSEDLPGPGGSVDIVAMDEGSE ASSCCSSALASKPSPEGASAASFEYTILDPSSQLL RPWTLCPELPPTPPHLKYLYLVVSDSGISTDYSS GDSQGAQGGLSDGPYSNPYENSLIPAAEPLPPS YVACS | 225 |
| EpoR(273-508)-FKBP(F36V)-FKBP(F36V) | SHRRALKQKIWPGIPSPESEFEGLFTTHKGNFQ LWLYQNDGCLWWSPCTPFTEDPPASLEVLSER CWGTMQAVEPGTDDEGPLLEPVGSEHAQDTYL VLDKWLLPRNPPSEDLPGPGGSVDIVAMDEGS EASSCCSSALASKPSPEGASAASFEYTILDPSSQL LRPWTLCPELPPTPPHLKYLYLVVSDSGISTDYS SGDSQGAQGGLSDGPYSNPYENSLIPAAEPLPP SYVACS MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLGVQVETISPGDGRTFPKRGQTCVV HYTGMLEDGKKVDSSRDRNKPFKFMLGKQEVI RGWEEGVAQMSVGQRAKLTISPDYAYGATGHP GIIPPHATLVFDVELLKLE | 226 |
| EpoR(273-508)-FKBP(E31G, 36V, R71G, K105E)-FKBP(E31G, 36V, R71G, K105E) | SHRRALKQKIWPGIPSPESEFEGLFTTHKGNFQ LWLYQNDGCLWWSPCTPFTEDPPASLEVLSER CWGTMQAVEPGTDDEGPLLEPVGSEHAQDTYL VLDKWLLPRNPPSEDLPGPGGSVDIVAMDEGS EASSCCSSALASKPSPEGASAASFEYTILDPSSQL LRPWTLCPELPPTPPHLKYLYLVVSDSGISTDYS SGDSQGAQGGLSDGPYSNPYENSLIPAAEPLPP SYVACS MGVQVETISPGDGRTFPKRGQTCVVHYTGMLG DGKKVDSSRDRNKPFKFMLGKQEVIRGWEEGV AQMSVGQGAKLTISPDYAYGATGHPGIIPPHATL VFDVELLELGVQVETISPGDGRTFPKRGQTCVV HYTGMLGDGKKVDSSRDRNKPFKFMLGKQEVI RGWEEGVAQMSVGQGAKLTISPDYAYGATGHP GIIPPHATLVFDVELLELE | 227 |
| FKBP(F36V)-EpoR(237-338; L241G, L242P)-GHR(353-638) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC PDEKTEESDTDRLLSSDHEKSHSNLGVKDGDS GRTSCCEPDILETDFNANDIHEGTSEVAQPQRL KGEADLLCLDQKNQNNSPYHDACPATQQPSVI QAEKNKPQPLPTEGAESTHQAAHIQLSNPSSLS NIDFYAQVSDITPAGSVVLSPGQKNKAGMSQCD MHPEMVSLCQENFLMDNAYFCEADAKKCIPVAP HIKVESHIQPSLNQEDIYITTESLTTAAGRPGTGE HVPGSEMPVPDYTSIHIVQSPQGLILNATALPLP DKEFLSSCGYVSTDQLNKIMP | 228 |
| FKBP(F36V)-EpoR(237-338; L241G, L242P)-IL2Rb(333-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC | 229 |

TABLE 2B-continued

Exemplary inducible chimeric cytokine receptor sequences

| Receptor name | Amino acid sequence | SEQ ID |
|---|---|---|
| | VTQLLLQQDKVPEPASLSSNHSLTSCFTNQGYF FFHLPDALEIEACQVYFTYDPYSEEDPDEGVAG APTGSSPQPLQPLSGEDDAYCTFPSRDDLLLFS PSLLGGPSPPSTAPGGSGAGEERMPPSLQERV PRDWDPQPLGPPTPGVPDLVDFQPPPELVLRE AGEEVPDAGPREGVSFPWSRPPGQGEFRALNA RLPLNTDAYLSLQELQGQDPTHLV | |
| FKBP(F36V)-EpoR(237-338; L241G, L242P)-IL7R(316-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 230 |
| FKBP(F36V)-EpoR(237-338; L241G, L242P)-IL12Rb2(714-862) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC VTPVFRHPPCSNWPQREKGIQGHQASEKDMM HSASSPPPPRALQAESRQLVDLYKVLESRGSDP KPENPACPWTVLPAGDLPTHDGYLPSNIDDLPS HEAPLADSLEELEPQHISLSVFPSSSLHPLTFSC GDKLTLDQLKMRCDSLML | 231 |
| FKBP(F36V)-EpoR(237-338; L241G, L242P)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC SDPKPENPACPWTVLPAGDLPTHDGYLPSNIDD LPSHEAPLADSLEELEPQ | 232 |
| FKBP(F36V)-EpoR(237-338; L241G, L242P)-IL21R(322-538) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS | 233 |
| FKBP(F36V)-EpoR(237-338; L241G, L242P)-IFNAR2(310-515) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC KKKVWDYNYDDESDSDTEAAPRTSGGGYTMH GLTVRPLGQASATSTESQLIDPESEEEPDLPEVD VELPTMPKDSPQQLELLSGPCERRKSPLQDPFP EEDYSSTEGSGGRITFNVDLNSVFLRVLDDEDS DDLEAPLMLSSHLEEMVDPEDPDNVQSNHLLAS GEGTQPTFPSPSSEGLWSEDAPSDQSDTSESD VDLGDGYIMR | 234 |

TABLE 2B-continued

Exemplary inducible chimeric cytokine receptor sequences

| Receptor name | Amino acid sequence | SEQ ID |
|---|---|---|
| FKBP(F36V)-<br>EpoR(237-338;<br>L241G, L242P)-<br>IFNAR1(300-520) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>RGVRPTPRVRAPATQQTRWKKDLAEDEEEEDE<br>EDTEDGVSFQPYIEPPSFLGQEHQAPGHSEAG<br>GVDSGRPRAPLVPSEGSSAWDSSDRSWASTV<br>DSSWDRAGSSGYLAEKGPGQGPGGDGHQESL<br>PPPEFSKDSGFLEELPEDNLSSWATWGTLPPEP<br>NLVPGGPPVSLQTLTFCWESSPEEEEARESEI<br>EDSDAGSWGAESTQRTEDRGRTLGHYMAR | 235 |
| FKBP(F36V)-<br>muEpoR(236-337;<br>L264G, L265P)-<br>muIL2Rb(337-539) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPASLLTASDLDPLILTLSLILVLISLGPTVLALLS<br>HRRTLQQKIWPGIPSPESEFEGLFTTHKGNFQL<br>WLLQRDGCLWWSPGSSFPEDPPAHLEVLSEPR<br>AVQLLLLQKDSAPLPSPSGHSQASCFTNQGYFF<br>FHLPNALEIESCQVYFTYDPCVEEEVEEDGSRL<br>PEGSPHPPLLPLAGEQDDYCAFPPRDDLLLFSP<br>SLSTPNTAYGGSRAPEERSPLSLHEGLPSLASR<br>DLMGLQRPLERMPEGDGEGLSANSSGEQASVP<br>EGNLHGQDQDRGQGPILTLNTDAYLSLQELQAQ<br>DSVHLI | 236 |
| FKBP(F36V)-<br>muEpoR(236-337;<br>L264G, L265P)-<br>muIL7R(316-459) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPASLLTASDLDPLILTLSLILVLISLGPTVLALLS<br>HRRTLQQKIWPGIPSPESEFEGLFTTHKGNFQL<br>WLLQRDGCLWWSPGSSFPEDPPAHLEVLSEPR<br>ARDEVESFLPNDLPAQPEELETQGHRAAVHSAN<br>RSPETSVSPPETVRRESPLRCLARNLSTCNAPP<br>LLSSRSPDYRDGDRNRPPVYQDLLPNSGNTNV<br>PVPVPQPLPFQSGILIPVSQRQPISTSSVLNQEE<br>AYVTMSSFYQNK | 237 |
| FKBP(F36V)-<br>EpoR(237-338;<br>L241G, L242P)-<br>IL7R(316-459)-<br>IL12Rb2(775-825) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 238 |
| FKBP(F36V)-<br>GP130(609-700)-<br>IL7R(316-459)-<br>IL12Rb2(775-825) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>TTPKFAQGEIEAIVVPVCLAFLLTTLLGVLFCFNK<br>RDLIKKHIWPNVPDPSKSHIAQWSPHTPPRHNF<br>NSKDQMYSDGNFTDVSVVEIEAND<br>ARDEVEGFLQDTFPQQLEESEKQRLGGDVQSP<br>NCPSEDVVITPESFGRDSSLTCLAGNVSACDAPI<br>LSSSRSLDCRESGKNGPHVYQDLLLSLGTTNST<br>LPPPFSLQSGILTLNPVAQGQPILTSLGSNQEEA<br>YVTMSSFYQNQ<br>SDPKPENPACPWTVLPAGDLPTHDGYLPSNIDD<br>LPSHEAPLADSLEELEPQ | 239 |

TABLE 2B-continued

Exemplary inducible chimeric cytokine receptor sequences

| Receptor name | Amino acid sequence | SEQ ID |
|---|---|---|
| FKBP(F36V)-PrIR(221-319)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE ATFIQIPSDFTMNDTTVWISVAVLSAVICLIIVWAV ALKGYSMVTCIFPPVPGPKIKGFDAHLLEKGKSE ELLSALGCQDFPPTSDYEDLLVEYLEVDD ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ SDPKPENPACPWTVLPAGDLPTHDGYLPSNIDD LPSHEAPLADSLEELEPQ | 240 |
| FKBP(F36V)-GHR(251-352)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE LPQMSQFTCEEDFYFPWLLIIIFGIFGLTVMLFVF LFSKQQRIKMLILPPVPVPKIGIDPDLLKEGKLE EVNTILAIHDSYKPEFHSDDSWVEFIELDIDE ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ SDPKPENPACPWTVLPAGDLPTHDGYLPSNIDD LPSHEAPLADSLEELEPQ | 241 |
| FKBP(F36V)-GCSFR(614-710)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE LTLMTLTPEGSELHIILGLFGLLLLLTCLCGTAWL CCSPNRKNPLWPSVPDPAHSSLGSVWPTIMEE DAFQLPGLGTPPITKLTVLEEDEKKPVPWE ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ SDPKPENPACPWTVLPAGDLPTHDGYLPSNIDD LPSHEAPLADSLEELEPQ | 242 |
| FKBP(F36V)-TPOR/MPLR(478-582)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ SDPKPENPACPWTVLPAGDLPTHDGYLPSNIDD LPSHEAPLADSLEELEPQ | 243 |
| FKBP(F36V)-EpoR(237-338; L241G, L242P)-IL7R(376-416) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC ACDAPILSSSRSLDCRESGKNGPHVYQDLLLSL GTTNSTLP | 244 |
| FKBP(F36V)-EpoR(237-338; L241G, L242P)- | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL | 245 |

TABLE 2B-continued

Exemplary inducible chimeric cytokine receptor sequences

| Receptor name | Amino acid sequence | SEQ ID |
|---|---|---|
| IL7R(424-459) | VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC GILTLNPVAQGQPILTSLGSNQEEAYVTMSSFYQ NQ | |
| FKBP(F36V)-EpoR(237-338; L241G, L242P)-IL7R(376-416, 424-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC ACDAPILSSSRSLDCRESGKNGPHVYQDLLLSL GTTNSTLPQGQPILTSLGSNQEEAYVTMSSFYQ NQ | 246 |
| FKBP(F36V)-EpoR(237-338; L241G, L242P)-IL7R(424-459; Y456F) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC GILTLNPVAQGQPILTSLGSNQEEAYVTMSSFFQ NQ | 247 |
| FKBP(F36V)-EpoR(237-338; L241G, L242P)-IL7R(376-416, 424-459; Y456F) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC ACDAPILSSSRSLDCRESGKNGPHVYQDLLLSL GTTNSTLPQGQPILTSLGSNQEEAYVTMSSFFFQ NQ | 248 |
| FKBP(F36V)-EpoR(237-338; L241G, L242P)-IL2Rb(393-433) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC DEGVAGAPTGSSPQPLQPLSGEDDAYCTFPSR DDLLLLFSPS | 249 |
| FKBP(F36V)-EpoR(237-338; L241G, L242P)-IL2Rb(518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC GQGEFRALNARLPLNTDAYLSLQELQGQDPTHLV | 250 |
| FKBP(F36V)-EpoR(237-338; L241G, L242P)-IL2Rb(339-379, 393-433) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC QQDKVPEPASLSSNHSLTSCFTNQGYFFFHLPD ALEIEACQDEGVAGAPTGSSPQPLQPLSGEDDA YCTFPSRDDLLLLFSPS | 251 |
| FKBP(F36V)-EpoR(237-338; L241G, L242P)-IL2Rb(339-379, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ | 252 |

TABLE 2B-continued

Exemplary inducible chimeric cytokine receptor sequences

| Receptor name | Amino acid sequence | SEQ ID |
|---|---|---|
| | LWLYQNDGCLWWSPCTPFTEDPPASLEVLSERC QQDKVPEPASLSSNHSLTSCFTNQGYFFFHLPD ALEIEACQ GQGEFRALNARLPLNTDAYLSLQELQGQDPTHLV | |
| FKBP(F36V)-EpoR(237-338; L241G, L242P)-IL2Rb(393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC DEGVAGAPTGSSPQPLQPLSGEDDAYCTFPSR DDLLLFSPSGQGEFRALNARLPLNTDAYLSLQEL QGQDPTHLV | 253 |
| FKBP(F36V)-EpoR(237-338; L241G, L242P)-IL2Rb(339-379, 393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV | 254 |
| FKBP(F36V)-EpoR(237-338; L241G, L242P)-EGFR(955-1186) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC VIQGDERMHLPSPTDSNFYRALMDEEDMDDVV DADEYLIPQQGFFSSPSTSRTPLLSSLSATSNNS TVACIDRNGLQSCPIKEDSFLQRYSSDPTGALTE DSIDDTFLPVPEYINQSVPKRPAGSVQNPVYHN QPLNPAPSRDPHYQDPHSTAVGNPEYLNTVQP TCVNSTFDSPAHWAQKGSHQISLDNPDYQQDF FPKEAKPNGIFKGSTAENAEYLRVAPQSSEFIGA | 255 |
| FKBP(F36V)-EpoR(237-338; L241G, L242P)-EGFR(955-1044, 1058-1186; Y974F) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC VIQGDERMHLPSPTDSNFFRALMDEEDMDDVV DADEYLIPQQGFFSSPSTSRTPLLSSLSATSNNS TVACIDRNGLQSCPIKEDSFLQRIDDTFLPVPEYI NQSVPKRPAGSVQNPVYHNQPLNPAPSRDPHY QDPHSTAVGNPEYLNTVQPTCVNSTFDSPAHW AQKGSHQISLDNPDYQQDFFPKEAKPNGIFKGS TAENAEYLRVAPQSSEFIGA | 256 |
| FKBP(F36V)-EpoR(237-338; L241G, L242P)-EGFR(955-1009; Y974F) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC VIQGDERMHLPSPTDSNFFRALMDEEDMDDVV DADEYLIPQQGFFSSPSTSRTP | 257 |
| FKBP(F36V)-EpoR(237-338; L241G, L242P)-EGFR(1019-1085) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SEPVSGPTPSDLDPLILTLSLILVVILVGPTVLALL SHRRALKQKIWPGIPSPESEFEGLFTTHKGNFQ LWLYQNDGCLWWSPCTPFTEDPPASLEVLSERC | 258 |

TABLE 2B-continued

Exemplary inducible chimeric cytokine receptor sequences

| Receptor name | Amino acid sequence | SEQ ID |
|---|---|---|
| | NNSTVACIDRNGLQSCPIKEDSFLQRIDDTFLPV<br>PEYINQSVPKRPAGSVQNPV | |
| FKBP(F36V)-<br>EpoR(237-338;<br>L241G, L242P)-<br>EGFR(1037-1044,<br>1058-1103;<br>Y1068/1101F) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>KEDSFLQRIDDTFLPVPEFINQSVPKRPAGSVQN<br>PVYHNQPLNPAPSRDPHFQD | 259 |
| FKBP(F36V)-<br>EpoR(237-338;<br>L241G, L242P)-<br>EGFR(1066-1118;<br>Y1068/1086F) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>VPEFINQSVPKRPAGSVQNPVFHNQPLNPAPSR<br>DPHYQDPHSTAVGNPEYLNTV | 260 |
| FKBP(F36V)-<br>EpoR(237-338;<br>L241G, L242P)-<br>EGFR(1122-1165) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>PEYLNTVQPTCVNSTFDSPAHWAQKGSHQISLD<br>NPDYQQDFFPKEAKPNGIFKG | 261 |
| FKBP(F36V)-<br>EpoR(237-338;<br>L241G, L242P)-<br>EGFR(1133-1186;<br>Y1148F) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>WAQKGSHQISLDNPDFQQDFFPKEAKPNGIFKG<br>STAENAEYLRVAPQSSEFIGA | 262 |
| FKBP(F36V)-<br>EpoR(237-338;<br>L241G, L242P)-<br>BLNK(53-208) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ASESPADEEEQWSDDFDSDYENPDEHSDSEMY<br>VMPAEENADDSYEPPPVEQETRPVHPALPFAR<br>GEYIDNRSSQRHSPPFSKTLPSKPSWPSEKARL<br>TSTLPALTALQKPQVPPKPKGLLEDEADYVVPV<br>EDNDENYIHPTESSSPPPEKAPMVNR | 263 |
| FKBP(F36V)-<br>EpoR(237-338;<br>L241G, L242P)-<br>BLNK(53-208; Y72F) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ<br>LWLYQNDGCLWWSPCTPFTEDPPASLEVLSERC<br>ASESPADEEEQWSDDFDSDFENPDEHSDSEMY<br>VMPAEENADDSYEPPPVEQETRPVHPALPFAR<br>GEYIDNRSSQRHSPPFSKTLPSKPSWPSEKARL<br>TSTLPALTALQKPQVPPKPKGLLEDEADYVVPV<br>EDNDENYIHPTESSSPPPEKAPMVNR | 264 |
| FKBP(F36V)-<br>EpoR(237-338;<br>L241G, L242P)-<br>BLNK(53-208;<br>Y72F, Y96F) | MGVQVETISPGDGRTFPKRGQTCVVHYTGMLE<br>DGKKVDSSRDRNKPFKFMLGKQEVIRGWEEGV<br>AQMSVGQRAKLTISPDYAYGATGHPGIIPPHATL<br>VFDVELLKLE<br>SEPVSGPTPSDLDPLILTLSLILVVILVGPTVLALL<br>SHRRALKQKIWPGIPSPESEFEGLFTTHKGNFQ | 265 |

TABLE 2B-continued

Exemplary inducible chimeric cytokine receptor sequences

| Receptor name | Amino acid sequence | SEQ ID |
|---|---|---|
| | LWLYQNDGCLWWSPCTPFTEDPPASLEVLSERC ASESPADEEEQWSDDFDSDFENPDEHSDSEMY VMPAEENADDSFEPPPVEQETRPVHPALPFAR GEYIDNRSSQRHSPPFSKTLPSKPSWPSEKARL TSTLPALTALQKPQVPPKPKGLLEDEADYVVPV EDNDENYIHPTESSSPPPEKAPMVNR | |
| FKBP(F36V)-TPOR/MPLR(478-582)-IL7R(316-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 266 |
| FKBP(F36V)-TPOR/MPLR(478-582)-IL2Rb(333-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL VTQLLLQQDKVPEPASLSSNHSLTSCFTNQGYF FFHLPDALEIEACQVYFTYDPYSEEDPDEGVAG APTGSSPQPLQPLSGEDDAYCTFPSRDDLLLFS PSLLGGPSPPSTAPGGSGAGEERMPPSLQERV PRDWDPQPLGPPTPGVPDLVDFQPPPELVLRE AGEEVPDAGPREGVSFPWSRPPGQGEFRALNA RLPLNTDAYLSLQELQGQDPTHLV | 267 |
| FKBP(F36V)-TPOR/MPLR(478-582)-IL2Rbsmall(393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL DEGVAGAPTGSSPQPLQPLSGEDDAYCTFPSR DDLLLFSPSGQGEFRALNARLPLNTDAYLSLQEL QGQDPTHLV | 268 |
| FKBP(F36V)-TPOR/MPLR(478-582)-IL2Rbsmall(339-379, 393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV | 269 |
| FKBP(F36V)-TPOR/MPLR(478-582)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 270 |

TABLE 2B-continued

Exemplary inducible chimeric cytokine receptor sequences

| Receptor name | Amino acid sequence | SEQ ID |
|---|---|---|
| | SDPKPENPACPWTVLPAGDLPTHDGYLPSNIDD LPSHEAPLADSLEELEPQ | |
| FKBP(F36V)- TPOR/MPLR(478-582)- IL7R(316-459)- IL21R(322-538) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS | 271 |
| FKBP(F36V)- TPOR/MPLR(478-582)- IL21R(322-538)- IL7R(316-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 272 |
| FKBP(F36V)- TPOR/MPLR(478-582)- IL2Rbsmall(393-433, 518-551)- IL21R(322-538) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL DEGVAGAPTGSSPQPLQPLSGEDDAYCTFPSR DDLLLFSPSGQGEFRALNARLPLNTDAYLSLQEL QGQDPTHLV PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS | 273 |
| FKBP(F36V)- TPOR/MPLR(478-582)- IL21R(322-538)- IL2Rbsmall(393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL | 274 |

TABLE 2B-continued

Exemplary inducible chimeric cytokine receptor sequences

| Receptor name | Amino acid sequence | SEQ ID |
|---|---|---|
| | DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS DEGVAGAPTGSSPQPLQPLSGEDDAYCTFPSR DDLLLFSPSGQGEFRALNARLPLNTDAYLSLQEL QGQDPTHLV | |
| FKBP(F36V)-TPOR/MPLR(478-582)-IL2Rbsmall(339-379, 393-433, 518-551)-IL21R(322-538) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS | 275 |
| FKBP(F36V)-TPOR/MPLR(478-582)-IL21R(322-538)-IL2Rbsmall(339-379, 393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL PRSPAKRLQLTELQEPAELVESDGVPKPSFWPT AQNSGGSAYSEERDRPYGLVSIDTVTVLDAEGP CTWPCSCEDDGYPALDLDAGLEPSPGLEDPLL DAGTTVLSCGCVSAGSPGLGGPLGSLLDRLKPP LADGEDWAGGLPWGGRSPGGVSESEAGSPLA GLDMDTFDSGFVGSDCSSPVECDFTSPGDEGP PRSYLRQWVIPPPLSSPGPQAS QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV | 276 |
| FKBP(F36V)-TPOR/MPLR(478-582)-IL2Rbsmall(393-433, 518-551)-IL7R(316-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL DEGVAGAPTGSSPQPLQPLSGEDDAYCTFPSR DDLLLFSPSGQGEFRALNARLPLNTDAYLSLQEL QGQDPTHLV ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAQGQPILTSLGSNQEEA YVTMSSFYQNQ | 277 |
| FKBP(F36V)-TPOR/MPLR(478-582)-IL7R(316-459)-IL2Rbsmall(393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI | 278 |

TABLE 2B-continued

Exemplary inducible chimeric cytokine receptor sequences

| Receptor name | Amino acid sequence | SEQ ID |
|---|---|---|
| | LSSSRSLDCRESGKNGPHVYQDLLLSLGTTNST LPPPFSLQSGILTLNPVAGQPILTSLGSNQEEA YVTMSSFYQNQ DEGVAGAPTGSSPQPLQPLSGEDDAYCTFPSR DDLLLFSPSGQGEFRALNARLPLNTDAYLSLQEL QGQDPTHLV | |
| FKBP(F36V)-TPOR/MPLR(478-582)-IL2Rbsmall(339-379, 393-433, 518-551)-IL7R(316-459) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAGQPILTSLGSNQEEA YVTMSSFYQNQ | 279 |
| FKBP(F36V)-TPOR/MPLR(478-582)-IL7R(316-459)-IL2Rbsmall(339-379, 393-433, 518-551) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAGQPILTSLGSNQEEA YVTMSSFYQNQ QQDKVPEPASLSSNHSLTSCFTNQGYFFFHLPD ALEIEACQDEGVAGAPTGSSPQPLQPLSGEDDA YCTFPSRDDLLLFSPSGQGEFRALNARLPLNTD AYLSLQELQGQDPTHLV | 280 |
| FKBP(F36V)-PD1(156-191)-TPOR/MPLR(514-582)-IL7R(316-459)-IL12Rb2(775-825) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE PSPSPRPAGQFQTLVVGVVGGLLGSLVLLVWVL AVI RWQFPAHYRRLRHALWPSLPDLHRVLGQYLRD TAALSPPKATVSDTCEEVEPSLLEILPKSSERTPL PL ARDEVEGFLQDTFPQQLEESEKQRLGGDVQSP NCPSEDVVITPESFGRDSSLTCLAGNVSACDAPI LSSSRSLDCRESGKNGPHVYQDLLLSLGTTNST LPPPFSLQSGILTLNPVAGQPILTSLGSNQEEA YVTMSSFYQNQ SDPKPENPACPWTVLPAGDLPTHDGYLPSNIDD LPSHEAPLADSLEELEPQ | 281 |
| FKBP(F36V)-TPOR/MPLR(478-582)-EGFR(1122-1165) | MGVQVETISPGDGRTFPKRGQTCVVHYTGMLE DGKKVDSSRDRNKPFKFMLGKQEVIRGWEEGV AQMSVGQRAKLTISPDYAYGATGHPGIIPPHATL VFDVELLKLE SDPTRVETATETAWISLVTALHLVLGLSAVLGLLL LRWQFPAHYRRLRHALWPSLPDLHRVLGQYLR DTAALSPPKATVSDTCEEVEPSLLEILPKSSERT PLPL PEYLNTVQPTCVNSTFDSPAHWAQKGSHQISLD NPDYQQDFFPKEAKPNGIFKG | 282 |
| FKBP(F36V)-TPOR/MPLR(478-582)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWISLVTALHLVLGLSAVLGLLLLR | 283 |

TABLE 2B-continued

Exemplary inducible chimeric cytokine receptor sequences

| Receptor name | Amino acid sequence | SEQ ID |
|---|---|---|
| FKBP switch containing wildtype TpoR TM sequence | WQFPAHYRRLRHALWPSLPDLHRVLGQYLRDTAAL SPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | |
| FKBP(F36V)-TPOR/MPLR(478-582; N-1)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETWISLVTALHLVLGLSAVLGLLLLRW QFPAHYRRLRHALWPSLPDLHRVLGQYLRDTAALSP PKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 284 |
| FKBP(F36V)-TPOR/MPLR(478-582; N-2)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETISLVTALHLVLGLSAVLGLLLLRWQF PAHYRRLRHALWPSLPDLHRVLGQYLRDTAALSPPK ATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 285 |
| FKBP(F36V)-TPOR/MPLR(478-582; N-2 + 1)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETISLVTALHLVLGLSAVLGLLLLRWQ FPAHYRRLRHALWPSLPDLHRVLGQYLRDTAALSPP KATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 286 |
| FKBP(F36V)-TPOR/MPLR(478-582; N-3)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETSLVTALHLVLGLLLLRWQF PAHYRRLRHALWPSLPDLHRVLGQYLRDTAALSPPK ATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 287 |
| FKBP(F36V)-TPOR/MPLR(478-582; N-4)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLVTALHLVLGLSAVLGLLLLRWQFP AHYRRLRHALWPSLPDLHRVLGQYLRDTAALSPPKA TVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 288 |

TABLE 2B-continued

Exemplary inducible chimeric cytokine receptor sequences

| Receptor name | Amino acid sequence | SEQ ID |
|---|---|---|
| FKBP(F36V)-TPOR/MPLR(478-582; N-4 + 1)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETILVTALHLVLGLSAVLGLLLLRWQFP AHYRRLRHALWPSLPDLHRVLGQYLRDTAALSPPKA TVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 289 |
| FKBP(F36V)-TPOR/MPLR(478-582; N-5)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETVTALHLVLGLSAVLGLLLLRWQFPA HYRRLRHALWPSLPDLHRVLGQYLRDTAALSPPKAT VSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 290 |
| FKBP(F36V)-TPOR/MPLR(478-582; N-6)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETTALHLVLGLSAVLGLLLLRWQFPAH YRRLRHALWPSLPDLHRVLGQYLRDTAALSPPKATV SDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 291 |
| FKBP(F36V)-TPOR/MPLR(478-582; N-7)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETALHLVLGLSAVLGLLLLRWQFPAHY RRLRHALWPSLPDLHRVLGQYLRDTAALSPPKATVS DTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 292 |
| FKBP(F36V)-TPOR/MPLR(478-582; N-8)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLHLVLGLSAVLGLLLLRWQFPAHYR RLRHALWPSLPDLHRVLGQYLRDTAALSPPKATVSD TCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 293 |
| FKBP(F36V)-TPOR/MPLR(478-582; N-9)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETHLVLGLSAVLGLLLLRWQFPAHYR RLRHALWPSLPDLHRVLGQYLRDTAALSPPKATVSD TCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS | 294 |

TABLE 2B-continued

Exemplary inducible chimeric cytokine receptor sequences

| Receptor name | Amino acid sequence | SEQ ID |
|---|---|---|
| | GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | |
| FKBP(F36V)-<br>TPOR/MPLR(478-582; N-<br>10)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETVLGLSAVLGLLLLRWQFPAHYRRL<br>RHALWPSLPDLHRVLGQYLRDTAALSPPKATVSDTC<br>EEVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 295 |
| FKBP(F36V)-<br>TPOR/MPLR(478-582; N-<br>11)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETVLGLSAVLGLLLLRWQFPAHYRRL<br>RHALWPSLPDLHRVLGQYLRDTAALSPPKATVSDTC<br>EEVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 296 |
| FKBP(F36V)-<br>TPOR/MPLR(478-582; N-<br>12)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETLGLSAVLGLLLLRWQFPAHYRRLR<br>HALWPSLPDLHRVLGQYLRDTAALSPPKATVSDTCE<br>EVEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 297 |
| FKBP(F36V)-<br>TPOR/MPLR(478-582; N-<br>13)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETGLSAVLGLLLLRWQFPAHYRRLRH<br>ALWPSLPDLHRVLGQYLRDTAALSPPKATVSDTCEE<br>VEPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 298 |
| FKBP(F36V)-<br>TPOR/MPLR(478-582; N-<br>14)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETLSAVLGLLLLRWQFPAHYRRLRHA<br>LWPSLPDLHRVLGQYLRDTAALSPPKATVSDTCEEV<br>EPSLLEILPKSSERTPLPL<br>ARDEVEGFLQDTFPQQLEESEKQRLGGDVQSPNCP<br>SEDVVITPESFGRDSSLTCLAGNVSACDAPILSSSRS<br>LDCRESGKNGPHVYQDLLLSLGTTNSTLPPPFSLQS<br>GILTLNPVAQGQPILTSLGSNQEEAYVTMSSFYQNQ<br>SDPKPENPACPWTVLPAGDLPTHDGYLPSNIDDLPS<br>HEAPLADSLEELEPQ | 299 |
| FKBP(F36V)-<br>TPOR/MPLR(478-582; N-<br>15)-IL7R(316-459)-<br>IL12Rb2(775-825) | MGVQVETISPGDGRTFPKRGQTCVVHYTGMLEDGK<br>KVDSSRDRNKPFKFMLGKQEVIRGWEEGVAQMSVG<br>QRAKLTISPDYAYGATGHPGIIPPHATLVFDVELLKLE<br>SDPTRVETATETSAVLGLLLLRWQFPAHYRRLRHAL<br>WPSLPDLHRVLGQYLRDTAALSPPKATVSDTCEEVE<br>PSLLEILPKSSERTPLPL | 300 |

TABLE 2B-continued

Exemplary inducible chimeric cytokine receptor sequences

| Receptor name | Amino acid sequence | SEQ ID |
|---|---|---|
| | ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | |
| FKBP(F36V)-TPOR/MPLR(478-582; N − 16)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAVLGLLLLRWQFPAHYRRLRHALW PSLPDLHRVLGQYLRDTAALSPPKATVSDTCEEVEP SLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 301 |
| FKBP(F36V)-TPOR/MPLR(478-582; N − 17)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETVLGLLLLRWQFPAHYRRLRHALWP SLPDLHRVLGQYLRDTAALSPPKATVSDTCEEVEPS LLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 302 |
| FKBP(F36V)-TPOR/MPLR(478-582; N − 18)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETLGLLLLRWQFPAHYRRLRHALWPS LPDLHRVLGQYLRDTAALSPPKATVSDTCEEVEPSLL EILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 303 |
| FKBP(F36V)-TPOR/MPLR(478-582; N + 1)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLISLVTALHLVLGLSAVLGLLLLR WQFPAHYRRLRHALWPSLPDLHRVLGQYLRDTAAL SPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 304 |
| FKBP(F36V)-TPOR/MPLR(478-582; N + 2)-IL7R(316-459)-IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWVLISLVTALHLVLGLSAVLGLLLL RWQFPAHYRRLRHALWPSLPDLHRVLGQYLRDTAA LSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 305 |
| FKBP(F36V)-TPOR/MPLR(478-582; N + 3)-IL7R(316-459)- | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE | 306 |

TABLE 2B-continued

Exemplary inducible chimeric cytokine receptor sequences

| Receptor name | Amino acid sequence | SEQ ID |
|---|---|---|
| IL12Rb2(775-825) | SDPTRVETATETAWLVLISLVTALHLVLGLSAVLGLLL LRWQFPAHYRRLRHALWPSLPDLHRVLGQYLRDTA ALSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | |
| FKBP(F36V)- TPOR/MPLR(478-582; N + 4)-IL7R(316-459)- IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWILVLISLVTALHLVLGLSAVLGLL LLRWQFPAHYRRLRHALWPSLPDLHRVLGQYLRDT AALSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 307 |
| FKBP(F36V)- TPOR/MPLR(478-582; N + 5)-IL7R(316-459)- IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLILVLISLVTALHLVLGLSAVLGL LLLRWQFPAHYRRLRHALWPSLPDLHRVLGQYLRD TAALSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 308 |
| FKBP(F36V)- TPOR/MPLR(478-582; N + 6)-IL7R(316-459)- IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLILVLISLVTALHLVLGLSAVLG LLLLRWQFPAHYRRLRHALWPSLPDLHRVLGQYLRD TAALSPPKATVSDTCEEVEPSLLEILPKSSERTPLPL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 309 |
| FKBP(F36V)- TPOR/MPLR(478-582; N + 7)-IL7R(316-459)- IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWVLLILVLISLVTALHLVLGLSAVL GLLLLRWQFPAHYRRLRHALWPSLPDLHRVLGQYL RDTAALSPPKATVSDTCEEVEPSLLEILPKSSERTPL PL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ SDPKPENPACPWTVLPAGDLPTHDGYLPSNIDDLPS HEAPLADSLEELEPQ | 310 |
| FKBP(F36V)- TPOR/MPLR(478-582; N + 7)-IL7R(316-459)- IL12Rb2(775-825) | MGVQVETISPGDGRTFPKRGQTCVVHYTGMLEDGK KVDSSRDRNKPFKFMLGKQEVIRGWEEGVAQMSVG QRAKLTISPDYAYGATGHPGIIPPHATLVFDVELLKLE SDPTRVETATETAWLVLLILVLISLVTALHLVLGLSAVL GLLLLRWQFPAHYRRLRHALWPSLPDLHRVLGQYL RDTAALSPPKATVSDTCEEVEPSLLEILPKSSERTPL PL ARDEVEGFLQDTFPQQLEESEKQRLGGDVQSPNCP SEDVVITPESFGRDSSLTCLAGNVSACDAPILSSSRS LDCRESGKNGPHVYQDLLLSLGTTNSTLPPPFSLQS GILTLNPVAQGQPILTSLGSNQEEAYVTMSSFYQNQ | 311 |

TABLE 2B-continued

Exemplary inducible chimeric cytokine receptor sequences

| Receptor name | Amino acid sequence | SEQ ID |
|---|---|---|
| | SDPKPENPACPWTVLPAGDLPTHDGYLPSNIDDLPS HEAPLADSLEELEPQ | |

The invention encompasses modifications to the inducible chimeric cytokine receptors of the invention embodiments shown in Tables 2A and 2B, including functionally equivalent proteins having modifications which do not significantly affect their properties and variants which have enhanced or decreased activity and/or affinity. Modification of polypeptides is routine practice in the art and need not be described in detail herein. Examples of modified polypeptides include polypeptides with conservative substitutions of amino acid residues, one or more deletions or additions of amino acids which do not significantly deleteriously change the functional activity, or which mature (enhance) the affinity of the polypeptide for its ligand, or use of chemical analogs.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to an epitope tag.

Substitution variants have at least one amino acid residue in the inducible chimeric cytokine receptor removed and a different residue inserted in its place. Conservative substitutions are shown in Table 3 under the heading of "conservative substitutions." If such substitutions result in a change in biological activity, then more substantial changes, denominated "exemplary substitutions" in Table 3, or as further described below in reference to amino acid classes, may be introduced and the products screened.

TABLE 3

Amino Acid Substitutions

| Original Residue (naturally occurring amino acid) | Conservative Substitutions | Exemplary Substitutions |
|---|---|---|
| Ala (A) | Val | Val; Leu; Ile |
| Arg (R) | Lys | Lys; Gln; Asn |
| Asn (N) | Gln | Gln; His; Asp, Lys; Arg |
| Asp (D) | Glu | Glu; Asn |
| Cys (C) | Ser | Ser; Ala |
| Gln (Q) | Asn | Asn; Glu |
| Glu (E) | Asp | Asp; Gln |
| Gly (G) | Ala | Ala |
| His (H) | Arg | Asn; Gln; Lys; Arg |
| Ile (I) | Leu | Leu; Val; Met; Ala; Phe; Norleucine |
| Leu (L) | Ile | Norleucine; Ile; Val; Met; Ala; Phe |
| Lys (K) | Arg | Arg; Gln; Asn |
| Met (M) | Leu | Leu; Phe; Ile |
| Phe (F) | Tyr | Leu; Val; Ile; Ala; Tyr |
| Pro (P) | Ala | Ala |
| Ser (S) | Thr | Thr |
| Thr (T) | Ser | Ser |
| Trp (W) | Tyr | Tyr; Phe |
| Tyr (Y) | Phe | Trp; Phe; Thr; Ser |
| Val (V) | Leu | Ile; Leu; Met; Phe; Ala; Norleucine |

In some embodiments, inducible chimeric cytokine receptors may be synthesized in situ in an isolated immune cell, such as a CAR-T cell, after introduction of polynucleotides encoding the inducible chimeric cytokine receptors into the cell. Alternatively, inducible chimeric cytokine receptors may be produced outside of cells, and then introduced into cells. Methods for introducing a polynucleotide construct into cells are known in the art. In some embodiments, stable transformation methods can be used to integrate the polynucleotide construct into the genome of the cell. In other embodiments, transient transformation methods can be used to transiently express the polynucleotide construct, and the polynucleotide construct not integrated into the genome of the cell. In other embodiments, virus-mediated methods can be used. The polynucleotides may be introduced into a cell by any suitable means such as for example, recombinant viral vectors (e.g. retroviruses, adenoviruses), liposomes, and the like. Transient transformation methods include, for example without limitation, microinjection, electroporation or particle bombardment. Polynucleotides may be included in vectors, such as for example plasmid vectors or viral vectors.

In some embodiments, an isolated immune cell, such as an isolated T cell, of the invention can comprise at least one inducible chimeric cytokine receptor and at least one CAR. In some embodiments, an isolated immune cell, such as an isolated T cell, can comprise at least a population of different inducible chimeric cytokine receptors and at least one CAR. For example, a population of different inducible chimeric cytokine receptors present in an isolated immune cell may comprise receptors with the same dimerization domain but different tyrosine kinase activating domains and different tyrosine effector domains, or receptors with the same dimerization domains, same tyrosine kinase activating domains but different tyrosine effector domains, or receptors with all three domains being different from each other, and the like. In some embodiments, an isolated immune cell, such as an isolated T cell, can comprise at least one inducible chimeric cytokine receptor and a population of CARs, each CAR comprising different extracellular ligand-binding domains.

Introducing a population of different inducible chimeric cytokine receptors into an immune cell can allow manipulation of the cell's functional outcome and/or phenotype. For example, different inducible chimeric cytokine receptors present in the isolated immune cell can activate different intracellular signaling events, each resulting in a particular functional outcome and/or directing the cell to a particular phenotype. By manipulating the population of the inducible chimeric cytokine receptors introduced into the cell, the cell's functional outcome and/or phenotype can be manipulated. For example, the population of inducible chimeric cytokine receptors introduced into the immune cell can be manipulated to comprise a greater number of receptors that activate one STAT transcription factor over the other STATs thereby skewing the cell's functional outcome and/or phenotype to the one governed by that STAT.

In some embodiments of an isolated immune cell, such as an isolated T cell provided herein, a CAR can comprise an extracellular ligand-binding domain (e.g., a single chain variable fragment (scFv)), a transmembrane domain, and an intracellular signaling domain. In some embodiments, the extracellular ligand-binding domain, transmembrane domain, and intracellular signaling domain are in one polypeptide, i.e., in a single chain. Multichain CARs and polypeptides are also provided herein. In some embodiments, the multichain CARs comprise: a first polypeptide comprising a transmembrane domain and at least one extracellular ligand-binding domain, and a second polypeptide comprising a transmembrane domain and at least one intracellular signaling domain, wherein the polypeptides assemble together to form a multichain CAR.

The extracellular ligand-binding domain of a CAR specifically binds to a target of interest. The target of interest can be any molecule of interest, including, for example without limitation BCMA, EGFRvIII, Flt-3, WT-1, CD20, CD23, CD30, CD38, CD70, CD33, CD133, LeY, NKG2D, CS1, CD44v6, ROR1, CD19, Claudin-18.2 (Claudin-18A2, or Claudin18 isoform 2), DLL3 (Delta-like protein 3, *Drosophila* Delta homolog 3, Delta3), Muc17 (Mucin17, Muc3, Muc3), FAP alpha (Fibroblast Activation Protein alpha), Ly6G6D (Lymphocyte antigen 6 complex locus protein G6d, c6orf23, G6D, MEGT1, NG25), RNF43 (E3 ubiquitin-protein ligase RNF43, RING finger protein 43).

In some embodiments, the extracellular ligand-binding domain of a CAR comprises an scFv comprising the light chain variable (VL) region and the heavy chain variable (VH) region of a target antigen specific monoclonal antibody joined by a flexible linker. Single chain variable region fragments are made by linking light and/or heavy chain variable regions by using a short linking peptide (Bird et al., Science 242:423-426, 1988). An example of a linking peptide is the GS linker having the amino acid sequence (GGGGS)$_3$ (SEQ ID NO: 224), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. Linkers can in turn be modified for additional functions, such as attachment of drugs or attachment to solid supports. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as *E. coli*. Polynucleotides encoding the scFv of interest can be made by routine manipulations such as ligation of polynucleotides. The resultant scFv can be isolated using standard protein purification techniques known in the art.

The intracellular signaling domain of a CAR according to the invention is responsible for intracellular signaling following the binding of extracellular ligand-binding domain to the target resulting in the activation of the immune cell and immune response. The intracellular signaling domain has the ability to activate of at least one of the normal effector functions of the immune cell in which the CAR is expressed. For example, the effector function of a T cell can be a cytolytic activity or helper activity including the secretion of cytokines.

In some embodiments, an intracellular signaling domain for use in a CAR can be the cytoplasmic sequences of, for example without limitation, the T cell receptor and co-receptors that act in concert to initiate signal transduction following antigen receptor engagement, as well as any derivative or variant of these sequences and any synthetic sequence that has the same functional capability. Intracellular signaling domains comprise two distinct classes of cytoplasmic signaling sequences: those that initiate antigen-dependent primary activation, and those that act in an antigen-independent manner to provide a secondary or co-stimulatory signal. Primary cytoplasmic signaling sequences can comprise signaling motifs which are known as immunoreceptor tyrosine-based activation motifs of ITAMs. ITAMs are well defined signaling motifs found in the intracytoplasmic tail of a variety of receptors that serve as binding sites for syk/zap70 class tyrosine kinases. Examples of ITAM used in the invention can include as non-limiting examples those derived from TCRζ, FcRγ, FcRβ, FcRε, CD3γ, CD3δ, CD3ε, CD5, CD22, CD79a, CD79b and CD66d. In some embodiments, the intracellular signaling domain of the CAR can comprise the CD3 signaling domain. In some embodiments the intracellular signaling domain of the CAR of the invention comprises a domain of a co-stimulatory molecule.

In some embodiments, the intracellular signaling domain of a CAR of the invention comprises a part of co-stimulatory molecule selected from the group consisting of fragment of 41BB (GenBank: AAA53133.) and CD28 (NP_006130.1).

CARs are expressed on the surface membrane of the cell. Thus, the CAR can comprise a transmembrane domain. Suitable transmembrane domains for a CAR disclosed herein have the ability to (a) be expressed at the surface of a cell, preferably an immune cell such as, for example without limitation, lymphocyte cells or Natural killer (NK) cells, and (b) interact with the ligand-binding domain and intracellular signaling domain for directing cellular response of immune cell against a predefined target cell. The transmembrane domain can be derived either from a natural or from a synthetic source. The transmembrane domain can be derived from any membrane-bound or transmembrane protein. As non-limiting examples, the transmembrane polypeptide can be a subunit of the T cell receptor such as α, β, γ or δ, polypeptide constituting CD3 complex, IL-2 receptor p55 (α chain), p75 (β chain) or γ chain, subunit chain of Fc receptors, in particular Fcγ receptor III or CD proteins. Alternatively, the transmembrane domain can be synthetic and can comprise predominantly hydrophobic residues such as leucine and valine. In some embodiments said transmembrane domain is derived from the human CD8α chain (e.g., NP_001139345.1). The transmembrane domain can further comprise a stalk domain between the extracellular ligand-binding domain and said transmembrane domain. A stalk domain may comprise up to 300 amino acids, preferably 10 to 100 amino acids and most preferably 25 to 50 amino acids. Stalk region may be derived from all or part of naturally occurring molecules, such as from all or part of the extracellular region of CD8, CD4, or CD28, or from all or part of an antibody constant region. Alternatively the stalk domain may be a synthetic sequence that corresponds to a naturally occurring stalk sequence, or may be an entirely synthetic stalk sequence. In some embodiments said stalk domain is a part of human CD8α chain (e.g., NP_001139345.1). In another particular embodiment, said transmembrane and hinge domains comprise a part of human CD8α chain. In some embodiments, CARs disclosed herein can comprise an extracellular ligand-binding domain that specifically binds BCMA, CD8α human hinge and transmembrane domains, the CD3ζ signaling domain, and 4-1BB signaling domain. In some embodiments, a CAR can be introduced into an immune cell as a transgene via a plasmid vector. In some embodiments, the plasmid vector can also contain, for example, a selection marker which provides for identification and/or selection of cells which received the vector.

Table 4 provides exemplary sequences of CAR components that can be used in the CARs disclosed herein.

TABLE 4

Exemplary sequences of CAR Components

| Domain | Amino acid sequence | SEQ ID |
|---|---|---|
| V5 epitope tag | KPIPNPLLGLDST | 179 |
| 2173 scFv | EIQLVQSGAEVKKPGESLRISCKGSGFNIEDYYI HWVRQMPGKGLEWMGRIDPENDETKYGPIFQG HVTISADTSINTVYLQWSSLKASDTAMYYCAFR GGVYWGQGTTVTVSSGGGGSGGGGSGGGGS GGGGSDVVMTQSPDSLAVSLGERATINCKSSQ SLLDSDGKTYLNWLQQKPGQPPKRLISLVSKLD SGVPDRFSGSGSGTDFTLTISSLQAEDVAVYYC WQGTHFPGTFGGGTKVEIK | 180 |
| 26C8 scFv | QVQLQESGPGLVKPSETLSLTCTVSDNSISNYY WSWIRQPPGKGLEWIAYIYYSGTTNYNPSLKSR VTISLDTSKNQFSLQLSSVTAADAAVYYCARVFH WGFAFDIWGQGTMVTVSSGGGGSGGGGSGG GGSEIVLTQSPGTLSLSPGERATLSCRASQRVS NTYLAWYQQNPGQAPRLLIYGASSRATGIPDRF SGSGSGTDFTLTISRLEPEDFAVYYCQQYGTSP LTFGGGTKVEIK | 181 |
| CD8 hinge and transmembrane | TTTPAPRPPTPAPTIASQPLSLRPEACRPAAGGA VHTRGLDFACDIYIWAPLAGTCGVLLLSLVITLYC | 182 |
| 4-1 BB intracellular signaling | KRGRKKLLYIFKQPFMRPVQTTQEEDGCSCRFP EEEEGGCEL | 183 |
| CD3z intracellular signaling | RVKFSRSADAPAYQQGQNQLYNELNLGRREEY DVLDKRRGRDPEMGGKPRRKNPQEGLYNELQ KDKMAEAYSEIGMKGERRRGKGHDGLYQGLST ATKDTYDALHMQALPPR | 184 |
| BFP | MSELIKENMHMKLYMEGTVDNHHFKCTSEGEG KPYEGTQTMRIKVVEGGPLPFAFDILATSFLYGS KTFINHTQGIPDFFKQSFPEGFTWERVTTYEDG GVLTATQDTSLQDGCLIYNVKIRGVNFTSNGPV MQKKTLGWEAFTETLYPADGGLEGRNDMALKL VGGSHLIANIKTTYRSKKPAKNLKMPGVYYVDY RLERIKEANNETYVEQHEVAVARYCDLPSKLGH KLN | 185 |
| P2A | GSGATNFSLLKQAGDVEENPGP | 186 |

CAR polypeptides may be synthesized in situ in the cell after introduction of polynucleotides encoding the CAR polypeptides into the cell. Alternatively, CAR polypeptides may be produced outside of cells, and then introduced into cells. Methods for introducing a polynucleotide construct into cells are known in the art. In some embodiments, stable transformation methods can be used to integrate the polynucleotide construct into the genome of the cell. In other embodiments, transient transformation methods can be used to transiently express the polynucleotide construct, and the polynucleotide construct not integrated into the genome of the cell. In other embodiments, virus-mediated methods can be used. The polynucleotides may be introduced into a cell by any suitable means such as for example, recombinant viral vectors (e.g. retroviruses, adenoviruses), liposomes, and the like. Transient transformation methods include, for example without limitation, microinjection, electroporation or particle bombardment. Polynucleotides may be included in vectors, such as for example plasmid vectors or viral vectors.

Also provided herein are isolated immune cells comprising at least one inducible chimeric cytokine receptor described herein. The isolated immune cells may further comprise a chimeric antigenic receptor (CAR). Isolated immune cells modified to express an inducible chimeric cytokine receptor and/or a CAR as referred throughout the specification are also interchangeably referred to as engineered immune cells. These isolated immune cells can be prepared according to any one of the methods described herein. Any immune cell capable of expressing heterologous DNAs can be used for the purpose of expressing the inducible chimeric cytokine receptor and CAR of interest. In some embodiments, the isolated immune cell is a T cell. In some embodiments, an immune cell can be derived from, for example without limitation, a stem cell. The stem cells can be adult stem cells, non-human embryonic stem cells, more particularly non-human stem cells, cord blood stem cells, progenitor cells, bone marrow stem cells, induced pluripotent stem cells, totipotent stem cells or hematopoietic stem cells. Representative human cells are CD34+ cells. In some embodiments, the isolated immune cell can be a dendritic cell, killer dendritic cell, a mast cell, a NK-cell, a macrophage, a monocyte, a B-cell or a T cell. In some embodiments, the isolated immune cell can be a T cell selected from the group consisting of inflammatory T-lymphocytes, cytotoxic T-lymphocytes, regulatory T-lymphocytes or helper T-lymphocytes. In some embodiments, the cell can be derived from the group consisting of CD4+ T-lymphocytes and CD8+T-lymphocytes. In some embodiments, the isolated immune cell is an autologous T cell. In some embodiments, the isolated immune cell is an allogeneic T cell.

In some embodiments, the CAR-immune cell (e.g., CAR-T cell) of the disclosure comprises a polynucleotide encoding a suicide polypeptide, such as for example RQR8. See, e.g., WO2013153391A, which is hereby incorporated by reference in its entirety. In some embodiments, a suicide polypeptide is expressed on the surface of the cell. In some embodiments, a suicide polypeptide is included in the CAR construct. In some embodiments, a suicide polypeptide is not part of the CAR construct.

In some embodiments, the extracellular domain of any one of CARs disclosed herein may comprise one or more epitopes specific for (specifically recognized by) a monoclonal antibody. These epitopes are also referred to herein as mAb-specific epitopes. Exemplary mAb-specific epitopes are disclosed in International Patent Publication No. WO 2016/120216, which is incorporated herein in its entirety. In these embodiments, the extracellular domain of the CARs comprise antigen binding domains that specifically bind to a target of interest and one or more epitopes that bind to one or more monoclonal antibodies (mAbs). CARs comprising the mAb-specific epitopes can be single-chain or multi-chain.

The inclusion of epitopes specific for monoclonal antibodies in the extracellular domain of the CARs described herein allows sorting and depletion of engineered immune cells expressing the CARs. In some embodiments, allowing for depletion provides a safety switch in case of deleterious effects, e.g., upon administration to a subject.

Prior to expansion and genetic modification, a source of cells can be obtained from a subject through a variety of non-limiting methods. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In some embodiments, any number of immune cell lines, such as T cell lines, available and known to those skilled in the art, may be used. In some embodiments, cells can be derived from a healthy donor, from a subject diagnosed with cancer or from a subject diagnosed with an infection. In some embodiments, cells can be part of a mixed population of cells which present different phenotypic characteristics.

Also provided herein are cell lines obtained from a transformed immune cell, such as a transformed T cell, according to any of the methods described herein. In some embodiments, an isolated immune cell such as an isolated T cell according to the invention comprises a polynucleotide encoding an inducible chimeric cytokine receptor. In some embodiments, an isolated immune cell according to the invention comprises a polynucleotide encoding an inducible chimeric cytokine receptor and a polynucleotide encoding a CAR. In some embodiments, an isolated immune cell according to the invention comprises a polynucleotide encoding an inducible chimeric cytokine receptor, a polynucleotide encoding a CAR, and a polynucleotide encoding an NK cell antagonist.

The isolated immune cells, such as isolated T cells, of the invention can be activated and expanded, either prior to or after genetic modification of the T cells, using methods as generally described, for example without limitation, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005. Immune cells can be expanded in vitro or in vivo. Generally, the T cells of the invention can be expanded, for example, by contact with an agent that stimulates a CD3 TCR complex and a co-stimulatory molecule on the surface of the T cells to create an activation signal for the T cell. For example, chemicals such as calcium ionophore A23187, phorbol 12-myristate 13-acetate (PMA), or mitogenic lectins like phytohemagglutinin (PHA) can be used to create an activation signal for the T cell.

In some embodiments, immune cell populations may be stimulated in vitro by contact with an appropriate antibody or antigen-binding fragment thereof. For example, T cell populations may be stimulated in vitro by contact with, for example, an anti-CD3 antibody, or antigen-binding fragment thereof, or an anti-CD28 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. Conditions appropriate for T cell culture include an appropriate media (e.g., Minimal Essential Media or RPMI Media 1640 or, X-vivo 5, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-2, IL-15, TGFp, and TNF, or any other additives for the growth of cells known to the skilled artisan. Other additives for the growth of cells include, but are not limited to, surfactant, plasmanate, and reducing agents such as N-acetyl-cysteine and 2-mercaptoethanoi. Media can include RPMI 1640, A1M-V, DMEM, MEM, a-MEM, F-12, X-Vivo 1, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$). T cells that have been exposed to varied stimulation times may exhibit different characteristics In some embodiments, the cells of the invention can be expanded by co-culturing with tissue or cells. The cells can also be expanded in vivo, for example in the subject's blood after administrating the cell into the subject.

In another aspect, the invention provides compositions (such as a pharmaceutical compositions) comprising any of the cells of the invention. In some embodiments, the composition comprises an isolated T cell comprising a polynucleotide encoding any of the inducible chimeric cytokine receptors described herein, and a polynucleotide encoding a CAR.

Expression vectors and administration of polynucleotide compositions are further described herein.

In another aspect, the invention provides a method of making any of the polynucleotides described herein.

Polynucleotides complementary to any such sequences are also encompassed by the invention. Polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the invention, and a polynucleotide may, but need not, be linked to other molecules and/or support materials.

Polynucleotides may comprise a native sequence (i.e., an endogenous sequence that encodes an antibody or a portion thereof) or may comprise a variant of such a sequence. Polynucleotide variants contain one or more substitutions, additions, deletions and/or insertions such that the immunoreactivity of the encoded polypeptide is not diminished, relative to a native immunoreactive molecule. The effect on the immunoreactivity of the encoded polypeptide may generally be assessed as described herein. Variants preferably exhibit at least about 70% identity, more preferably, at least about 80% identity, yet more preferably, at least about 90% identity, and most preferably, at least about 95% identity to a polynucleotide sequence that encodes a native antibody or a portion thereof.

Two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, or 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, WI), using default parameters. This program embodies several alignment schemes described in the following references: Dayhoff, M. O., 1978, A model of evolutionary change in proteins—Matrices for detecting distant relationships. In Dayhoff, M. O. (ed.) Atlas of Protein Sequence and Structure, National Biomedical Research Foundation, Washington DC Vol. 5, Suppl. 3, pp. 345-358; Hein J., 1990, Unified Approach to Alignment and Phylogenes pp. 626-645 Methods in Enzymology vol. 183, Academic Press, Inc., San Diego, CA; Higgins, D. G. and Sharp, P. M., 1989, CABIOS 5:151-153; Myers, E. W. and Muller W., 1988, CABIOS 4:11-17; Robinson, E. D., 1971, Comb. Theor. 11:105; Santou, N., Nes, M., 1987, Mol. Biol. Evol. 4:406-425; Sneath, P. H. A. and Sokal, R. R., 1973, Numerical Taxonomy the Principles and Practice of Numerical Taxonomy, Freeman Press, San Francisco, CA; Wilbur, W. J. and Lipman, D. J., 1983, Proc. Natl. Acad. Sci. USA 80:726-730.

Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e. the window size) and multiplying the results by 100 to yield the percentage of sequence identity.

Variants may also, or alternatively, be substantially homologous to a native gene, or a portion or complement thereof. Such polynucleotide variants are capable of hybridizing under moderately stringent conditions to a naturally occurring DNA sequence encoding a native antibody (or a complementary sequence).

Suitable "moderately stringent conditions" include prewashing in a solution of 5×SSC, 0.5% SDS, 1.0 mM EDTA (pH 8.0); hybridizing at 50° C.-65° C., 5×SSC, overnight; followed by washing twice at 65° C. for 20 minutes with each of 2×, 0.5× and 0.2×SSC containing 0.1% SDS.

As used herein, "highly stringent conditions" or "high stringency conditions" are those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. The skilled artisan will recognize how to adjust the temperature, ionic strength, etc. as necessary to accommodate factors such as probe length and the like.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the invention. Further, alleles of the genes comprising the polynucleotide sequences provided herein are within the scope of the invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

The polynucleotides of this invention can be obtained using chemical synthesis, recombinant methods, or PCR. Methods of chemical polynucleotide synthesis are well known in the art and need not be described in detail herein. One of skill in the art can use the sequences provided herein and a commercial DNA synthesizer to produce a desired DNA sequence.

For preparing polynucleotides using recombinant methods, a polynucleotide comprising a desired sequence can be inserted into a suitable vector, and the vector in turn can be introduced into a suitable host cell for replication and amplification, as further discussed herein. Polynucleotides may be inserted into host cells by any means known in the art. Cells are transformed by introducing an exogenous polynucleotide by direct uptake, endocytosis, transfection, F-mating or electroporation. Once introduced, the exogenous polynucleotide can be maintained within the cell as a non-integrated vector (such as a plasmid) or integrated into the host cell genome. The polynucleotide so amplified can be isolated from the host cell by methods well known within the art. See, e.g., Sambrook et al., 1989.

Alternatively, PCR allows reproduction of DNA sequences. PCR technology is well known in the art and is described in U.S. Pat. Nos. 4,683,195, 4,800,159, 4,754,065 and 4,683,202, as well as PCR: The Polymerase Chain Reaction, Mullis et al. eds., Birkauswer Press, Boston, 1994.

RNA can be obtained by using the isolated DNA in an appropriate vector and inserting it into a suitable host cell. When the cell replicates and the DNA is transcribed into RNA, the RNA can then be isolated using methods well known to those of skill in the art, as set forth in Sambrook et al., 1989, supra, for example.

Suitable cloning vectors may be constructed according to standard techniques, or may be selected from a large number of cloning vectors available in the art. While the cloning vector selected may vary according to the host cell intended to be used, useful cloning vectors will generally have the ability to self-replicate, may possess a single target for a particular restriction endonuclease, and/or may carry genes for a marker that can be used in selecting clones containing the vector. Suitable examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Stratgene, and Invitrogen.

Expression vectors generally are replicable polynucleotide constructs that contain a polynucleotide according to the invention. It is implied that an expression vector must be replicable in the host cells either as episomes or as an integral part of the chromosomal DNA. Suitable expression vectors include but are not limited to plasmids, viral vectors, including adenoviruses, adeno-associated viruses, retroviruses, cosmids, and expression vector(s) disclosed in PCT Publication No. WO 87/04462. Vector components may generally include, but are not limited to, one or more of the following: a signal sequence; an origin of replication; one or more marker genes; suitable transcriptional controlling elements (such as promoters, enhancers and terminator). For expression (i.e., translation), one or more translational controlling elements are also usually required, such as ribosome binding sites, translation initiation sites, and stop codons.

The vectors containing the polynucleotides of interest can be introduced into the host cell by any of a number of appropriate means, including electroporation, transfection employing calcium chloride, rubidium chloride, calcium phosphate, DEAE-dextran, or other substances; microprojectile bombardment; lipofection; and infection (e.g., where the vector is an infectious agent such as vaccinia virus). The choice of introducing vectors or polynucleotides will often depend on features of the host cell.

A polynucleotide encoding an inducible chimeric cytokine receptor or a CAR disclosed herein may exist in an expression cassette or expression vector (e.g., a plasmid for introduction into a bacterial host cell, or a viral vector such as a baculovirus vector for transfection of an insect host cell, or a plasmid or viral vector such as a lentivirus for transfection of a mammalian host cell). In some embodiments, a polynucleotide encoding an inducible chimeric cytokine receptor and/or a CAR is introduced into an isolated immune cell using a non-viral vector. Exemplary non-viral vectors that may be used in the methods of the present disclosure include, but are not limited to, transposon-based vectors such as PiggyBac™, Frog Prince, Sleeping Beauty (e.g., SB100X vector), and the like. In some embodiments, a polynucleotide encoding an inducible chimeric cytokine receptor and/or a CAR is integrated into the cell's genome. In some embodiments, the integration is site-specific. Exemplary methods to provide site-specific integration include methods employing genome-editing nucleases, such as meganucleases, zinc finger nucleases (ZFNs), transcription activator-like effector nucleases (TALENs), and clustered, regularly interspaced, short palindromic repeat-associated nucleases (CRISPR) such as Cas9 endonuclease.

In some embodiments, a polynucleotide or vector can include a nucleic acid sequence encoding ribosomal skip sequences such as, for example without limitation, a sequence encoding a 2A peptide. 2A peptides, which were identified in the Aphthovirus subgroup of picornaviruses, causes a ribosomal "skip" from one codon to the next without the formation of a peptide bond between the two amino acids encoded by the codons (see (Donnelly and Elliott 2001; Atkins, Wills et al. 2007; Doronina, Wu et al. 2008)). By "codon" is meant three nucleotides on an mRNA (or on the sense strand of a DNA molecule) that are translated by a ribosome into one amino acid residue. Thus, two, three, four, or more polypeptides can be synthesized from a single, contiguous open reading frame within an imRNA when the polypeptides are separated by a 2A oligopeptide sequence that is in frame. Such ribosomal skip mechanisms are well known in the art and are known to be used by several vectors for the expression of several proteins encoded by a single messenger RNA.

To direct transmembrane polypeptides into the secretory pathway of a host cell, in some embodiments, a secretory signal sequence (also known as a leader sequence, prepro sequence or pre sequence) is provided in a polynucleotide sequence or vector sequence. The secretory signal sequence is operably linked to the transmembrane nucleic acid sequence, i.e., the two sequences are joined in the correct reading frame and positioned to direct the newly synthesized polypeptide into the secretory pathway of the host cell. Secretory signal sequences are commonly positioned 5' to the nucleic acid sequence encoding the polypeptide of interest, although certain secretory signal sequences may be positioned elsewhere in the nucleic acid sequence of interest (see, e.g., Welch et al., U.S. Pat. No. 5,037,743; Holland et al., U.S. Pat. No. 5,143,830). In some embodiments the signal peptide comprises the amino acid sequence shown in SEQ ID NO: 318 or 329. Those skilled in the art will recognize that, in view of the degeneracy of the genetic code, considerable sequence variation is possible among these polynucleotide molecules. In some embodiments, nucleic acid sequences of the invention are codon-optimized for expression in mammalian cells, preferably for expression in human cells. Codon-optimization refers to the exchange in a sequence of interest of codons that are generally rare in highly expressed genes of a given species by codons that are generally frequent in highly expressed genes of such species, such codons encoding the amino acids as the codons that are being exchanged.

Methods of preparing immune cells for use in immunotherapy are provided herein. In some embodiments, the methods comprise introducing an inducible chimeric cytokine receptor and a CAR into immune cells, and expanding the cells. In some embodiments, the invention relates to a method of engineering an immune cell comprising: providing a cell and expressing an inducible chimeric cytokine receptor, and expressing at the surface of the cell at least one CAR. In some embodiments, the method comprises: transfecting the cell with at least one polynucleotide encoding an inducible chimeric cytokine receptor, and at least one polynucleotide encoding a CAR, and expressing the polynucleotides in the cell. In some embodiments, the method comprises: transfecting the cell with at least one polynucleotide encoding an inducible chimeric cytokine receptor, at least one polynucleotide encoding a CAR, and expressing the polynucleotides in the cell.

In some embodiments, the polynucleotides encoding the inducible chimeric cytokine receptor and CAR are present in one or more expression vectors for stable expression in the cells. In some embodiments, the polynucleotides are present in viral vectors for stable expression in the cells. In some embodiments, the viral vectors may be for example, lentiviral vectors or adenoviral vectors.

In some embodiments, polynucleotides encoding polypeptides according to the present invention can be mRNA which is introduced directly into the cells, for example by electroporation. In some embodiments, cytoPulse technology, such as PulseAgile, can be used to transiently permeabilize living cells for delivery of material into the cells (e.g. http://cytopulse.com; U.S. Pat. No. 6,078,490; PCT/US2011/000827; and PCT/US2004/005237). Parameters can be modified in order to determine conditions for high transfection efficiency with minimal mortality.

Also provided herein are methods of transfecting an immune cell, such as a T cell. In some embodiments, the method comprises: contacting an immune cell with RNA and applying to an immune cell an agile pulse sequence consisting of: (a) an electrical pulse with a voltage range from about 2250 to 3000 V per centimeter; (b) a pulse width of 0.1 ms; (c) a pulse interval of about 0.2 to 10 ms between the electrical pulses of step (a) and (b); (d) an electrical pulse with a voltage range from about 2250 to 3000 V with a pulse width of about 100 ms and a pulse interval of about 100 ms between the electrical pulse of step (b) and the first electrical pulse of step (c); and (e) four electrical pulses with a voltage of about 325 V with a pulse width of about 0.2 ms and a pulse interval of 2 ms between each of 4 electrical pulses. In some embodiments, a method of transfecting an immune cell comprises contacting said immune cell with RNA and applying to immune cell an agile pulse sequence comprising: (a) an electrical pulse with a voltage of about 2250, 2300, 2350, 2400, 2450, 2500, 2550, 2400, 2450, 2500, 2600, 2700, 2800, 2900 or 3000V per centimeter; (b) a pulse width of 0.1 ms; (c) and a pulse interval of about 0.2, 0.5, 1, 2, 3, 4, 5, 6, 7, 8, 9 or 10 ms between the electrical pulses of step (a) and (b); (d) one electrical pulse with a voltage range from about 2250, of 2250, 2300, 2350, 2400, 2450, 2500, 2550, 2400, 2450, 2500, 2600, 2700, 2800, 2900 or 3000V with a pulse width of 100 ms and a pulse interval of 100 ms between the electrical pulse of step (b) and the first electrical pulse of step (c); and (e) 4 electrical pulses with a voltage of about 325 V with a pulse width of about 0.2 ms and a pulse interval of about 2 ms between each of 4 electrical pulses. Any values included in the value range described above are disclosed in the present application. Electroporation medium can be any suitable medium known in the art. In some embodiments, the electroporation medium has conductivity in a range spanning about 0.01 to about 1.0 milliSiemens.

In some embodiments, the method can further comprise a step of genetically modifying a cell by inactivating at least one gene expressing, for example without limitation, a component of the TCR, a target for an immunosuppressive agent, an HLA gene, and/or an immune checkpoint protein such as, for example, PDCD1 or CTLA-4. By inactivating a gene it is intended that the gene of interest is not expressed in a functional protein form. In some embodiments, the gene to be inactivated is selected from the group consisting of, for example without limitation, TCRα, TCRβ, CD52, GR, deoxycytidine kinase (DCK), PD-1, and CTLA-4. In some embodiments the method comprises inactivating one or more genes by introducing into the cells a rare-cutting endonuclease able to selectively inactivate a gene by selective DNA cleavage. In some embodiments the rare-cutting endonuclease can be, for example, a transcription activator-like effector nuclease (TALE-nuclease) or Cas9 endonuclease.

In another aspect, a step of genetically modifying cells can comprise: modifying the immune cells by inactivating at least one gene expressing a target for an immunosuppressive agent, and; expanding the cells, optionally in presence of the immunosuppressive agent. An immunosuppressive agent is an agent that suppresses immune function by one of several mechanisms of action. An immunosuppressive agent can diminish the extent and/or voracity of an immune response. Non-limiting examples of immunosuppressive agents include calcineurin inhibitors, targets of rapamycin, interleukin-2 α-chain blockers, inhibitors of inosine monophosphate dehydrogenase, inhibitors of dihydrofolic acid reductase, corticosteroids, and immunosuppressive antimetabolites. Some cytotoxic immunosuppressants act by inhibiting DNA synthesis. Others may act through activation of T cells or by inhibiting the activation of helper cells. The methods according to the invention allow conferring immunosuppressive resistance to T cells for immunotherapy by inactivating the target of the immunosuppressive agent in T cells. As non-limiting examples, targets for immunosuppressive agent can be a receptor for an immunosuppressive agent such as for example without limitation CD52, glucocorticoid receptor (GR), FKBP family gene members, and cyclophilin family gene members.

Therapeutic Methods

Isolated immune cells obtained by the methods described above, or cell lines derived from such isolated immune cells, can be administered to a subject in need thereof and used as a medicament. In some embodiments, the isolated immune cell is a T cell. In some embodiments, such a medicament can be used for treating a disorder such as for example a viral disease, a bacterial disease, a cancer, an inflammatory disease, an immune disease, or an aging-associated disease. In some embodiments, the cancer can be selected from the group consisting of gastric cancer, sarcoma, lymphoma, leukemia, head and neck cancer, thymic cancer, epithelial cancer, salivary cancer, liver cancer, stomach cancer, thyroid cancer, lung cancer, ovarian cancer, breast cancer, prostate cancer, esophageal cancer, pancreatic cancer, glioma, leukemia, multiple myeloma, renal cell carcinoma, bladder cancer, cervical cancer, choriocarcinoma, colon cancer, oral cancer, skin cancer, and melanoma. In some embodiments, the subject is a previously treated adult subject with locally advanced or metastatic melanoma, squamous cell head and neck cancer (SCHNC), ovarian carcinoma, sarcoma, or relapsed or refractory classic Hodgkin's Lymphoma (cHL).

In some embodiments, isolated immune cells, such as isolated T cells, according to the invention, or cell line derived from the isolated immune cells, can be used in the manufacture of a medicament for treatment of a disorder in a subject in need thereof. In some embodiments, the disorder can be, for example, a cancer, an autoimmune disorder, or an infection.

Also provided herein are methods for treating subjects. In some embodiments, the method comprises providing an isolated immune cell comprising an inducible chimeric cytokine receptor of the invention to a subject in need thereof. In some embodiments, the method comprises a step of administering isolated immune cells of the invention to a subject in need thereof. In an exemplary embodiment, the method comprises providing an isolated T cell comprising an inducible chimeric cytokine receptor of the invention to a subject in need thereof. In some embodiments, the method comprises a step of administering isolated T cells of the invention to a subject in need thereof.

In some embodiments, isolated immune cells of the invention can undergo robust in vivo cell expansion and can persist for an extended amount of time.

The methods can further comprise administering one or more therapeutic agents to a subject prior to administering the engineered immune cells bearing a CAR and an inducible chimeric cytokine receptor provided herein. In certain embodiments, the agent is a lymphodepleting (preconditioning) regimen. For example, methods of lymphodepleting a subject in need of such therapy comprise administering to the subject specified beneficial doses of cyclophosphamide (between 200 mg/m$^2$/day and 2000 mg/m$^2$/day, about 100 mg/m$^2$/day and about 2000 mg/m$^2$/day; e.g., about 100 mg/m$^2$/day, about 200 mg/m$^2$/day, about 300 mg/m$^2$/day, about 400 mg/m$^2$/day, about 500 mg/m$^2$/day, about 600 mg/m$^2$/day, about 700 mg/m$^2$/day, about 800 mg/m$^2$/day, about 900 mg/m$^2$/day, about 1000 mg/m$^2$/day, about 1500 mg/m$^2$/day or about 2000 mg/m$^2$/day) and specified doses of fludarabine (between 20 mg/m$^2$/day and 900 mg/m$^2$/day, between about 10 mg/m$^2$/day and about 900 mg/m$^2$/day; e.g., about 10 mg/m$^2$/day, about 20 mg/m$^2$/day, about 30 mg/m$^2$/day, about 40 mg/m$^2$/day, about 40 mg/m$^2$/day, about 50 mg/m$^2$/day, about 60 mg/m$^2$/day, about 70 mg/m$^2$/day, about 80 mg/m$^2$/day, about 90 mg/m$^2$/day, about 100 mg/m$^2$/day, about 500 mg/m$^2$/day or about 900 mg/m$^2$/day). An exemplary dosing regimen involves treating a subject comprising administering daily to the patient about 300 mg/m$^2$/day of cyclophosphamide in combination or before or after administering about 30 mg/m$^2$/day of fludarabine for three days prior to administration of a therapeutically effective amount of engineered immune cells to the patien.

In some embodiments, notably in the case when the engineered cells provided herein have been gene edited to eliminate or minimize surface expression of CD52, lymphodepletion further comprises administration of an anti-CD52 antibody, such as alemtuzumab. In some embodiments, the CD52 antibody is administered at a dose of about 1-20 mg/day IV, e.g., about 13 mg/day IV for 1, 2, 3 or more days. The antibody can be administered in combination with, before, or after administration of other elements of a lymphodepletion regime (e.g., cyclophosphamide and/or fludarabine).

In certain embodiments, compositions comprising CAR-expressing immune effector cells disclosed herein may be administered in conjunction with any number of chemotherapeutic agents.

Methods of treatment of the invention can be ameliorating, curative or prophylactic. The method of the invention may be either part of an autologous immunotherapy or part of an allogenic immunotherapy treatment. The invention is particularly suitable for allogeneic immunotherapy. In an exemplary embodiment, T cells from donors can be transformed into non-alloreactive cells using standard protocols and reproduced as needed, thereby producing CAR-T cells which may be administered to one or several subjects. Such CAR-T cell therapy can be made available as an "off the shelf" therapeutic product.

In another aspect, the invention provides a method of inhibiting tumor growth or progression in a subject who has a tumor, comprising administering to the subject an effective amount of isolated immune cells as described herein. In another aspect, the invention provides a method of inhibiting or preventing metastasis of cancer cells in a subject, comprising administering to the subject in need thereof an effective amount of isolated immune cells as described herein. In another aspect, the invention provides a method of inducing tumor regression in a subject who has a tumor, comprising administering to the subject an effective amount of isolated immune cells as described herein. In an exemplary embodiment, the isolated immune cell is a T cell.

In some embodiments, the isolated immune cells can be administered parenterally in a subject. In some embodiments, the subject is a human.

Also provided is the use of any of the isolated immune cells provided herein in the manufacture of a medicament for the treatment of cancer or for inhibiting tumor growth or progression in a subject in need thereof. In an exemplary embodiment, the isolated immune cell is a T cell.

In some embodiments, treatment can be administrated into subjects undergoing an immunosuppressive treatment. Indeed, the invention preferably relies on cells or population of cells, which have been made resistant to at least one immunosuppressive agent due to the inactivation of a gene encoding a receptor for such immunosuppressive agent. In this aspect, the immunosuppressive treatment should help the selection and expansion of the immune cells according to the invention within the subject. The administration of the cells or population of cells according to the invention may be carried out in any convenient manner, including by aerosol inhalation, injection, ingestion, transfusion, implantation or transplantation. The compositions described herein may be administered to a subject subcutaneously, intradermaliy, intratumorally, intranodally, intramedullary, intramuscularly, by intravenous or intralymphatic injection, or intraperitoneally. In some embodiments, the cell compositions of the invention are preferably administered by intravenous injection.

In some embodiments the administration of the cells or population of cells can comprise administration of, for example, about $10^4$ to about $10^9$ cells per kg body weight including all integer values of cell numbers within those ranges. In some embodiments the administration of the cells or population of cells can comprise administration of about $10^5$ to $10^6$ cells per kg body weight including all integer values of cell numbers within those ranges. The cells or population of cells can be administrated in one or more doses. In some embodiments, said effective amount of cells can be administrated as a single dose. In some embodiments, said effective amount of cells can be administrated as more than one dose over a period time. Timing of administration is within the judgment of managing physician and depends on the clinical condition of the subject. The cells or population of cells may be obtained from any source, such as a blood bank or a donor. While individual needs vary, determination of optimal ranges of effective amounts of a given cell type for a particular disease or conditions within the skill of the art. An effective amount means an amount which provides a therapeutic or prophylactic benefit. The dosage administrated will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection within a tumor.

Kits

The invention also provides kits for use in the instant methods. Kits of the invention include one or more containers comprising an isolated immune cell comprising one or more polynucleotide(s) encoding an inducible chimeric cytokine receptor and a CAR as described herein, and instructions for use in accordance with any of the methods of the invention described herein. Generally, these instructions comprise a description of administration of the isolated immune cell for the above described therapeutic treatments. In an exemplary embodiment, kits may comprise an isolated T cell.

The instructions relating to the use of the isolated immune cells as described herein generally include information as to dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The kits of this invention are in suitable packaging. Suitable packaging includes, but is not limited to, vials, bottles, jars, flexible packaging (e.g., sealed Mylar or plastic bags), and the like. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is an isolated immune cell comprising an inducible chimeric cytokine receptor and a CAR. The container may further comprise a second pharmaceutically active agent.

Kits may optionally provide additional components such as buffers and interpretive information. Normally, the kit comprises a container and a label or package insert(s) on or associated with the container.

The following examples are offered for illustrative purposes only, and are not intended to limit the scope of the invention in any way. Indeed, various modifications of the invention in addition to those shown and described herein will become apparent to those skilled in the art from the foregoing description and fall within the scope of the appended claims.

NUMBERED EMBODIMENTS

The inventions disclosed herein may be defined by reference to the following numbered illustrative embodiments.

Embodiment 1

An inducible chimeric cytokine receptor comprising:
a dimerization domain;
a tyrosine kinase activating domain; and
a tyrosine effector domain.

Embodiment 2

The inducible chimeric cytokine receptor of embodiment 1, wherein the dimerization domain binds a small molecule.

Embodiment 3

The inducible chimeric cytokine receptor of embodiment 1 or 2, wherein the dimerization domain binds to the dimeric ligand AP1903, AP20187, dimeric FK506, or a dimeric FK506-like analog.

Embodiment 4

The inducible chimeric cytokine receptor of any one of embodiments 1 to 3, wherein the dimerization domain comprises an FKBP12 polypeptide.

Embodiment 5

The inducible chimeric cytokine receptor of embodiment 4, wherein the FKBP12 polypeptide contains the amino acid substitution F36V.

Embodiment 6

The inducible chimeric cytokine receptor of embodiment 1, wherein the dimerization domain binds a protein.

Embodiment 7

The inducible chimeric cytokine receptor of embodiment 1, wherein the dimerization domain comprises a polypeptide of a protein selected from the group consisting of: FKBP, cyclophilin, steroid binding protein, estrogen binding protein, glucocorticoid binding protein, vitamin D binding protein, tetracycline binding protein, extracellular domain of a cytokine receptor, receptor tyrosine kinase, TNFR-family receptor, and immune co-receptor.

Embodiment 8

The inducible chimeric cytokine receptor of embodiment 7, wherein the immune co-receptor is selected from the group consisting of: erythropoietin receptor, prolactin receptor, growth hormone receptor, thrombopoietin receptor, granulocyte colony-stimulating factor receptor, GP130, common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, TGFBR1/ALKL5, TGFBR2, EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, RTK106, TNFR1, Fas, TRAILR1, TRAILR2, NGFR, DR3, DR6, EDAR, TNFR2, LTbR, OX40, CD40, CD27, CD30, 4-1BB, RANK, Fn14, TACI, BAFFR, HVEM, BCMA, GITR, TROY, RELT, XEDAR, TRAILR3, TRAILR4, OPG, DcR3, PD-1, CD80, CD86, ICOS-L, ICOS, CTLA-4, BTLA, CD160, LAG3, and TIM3.

Embodiment 9

The inducible chimeric cytokine receptor of any one of embodiments 1 to 8, wherein the tyrosine kinase activating domain is derived from, or comprises a polypeptide of, a protein selected from the group consisting of: common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, and RTK106 receptor.

Embodiment 10

The inducible chimeric cytokine receptor of any one of embodiments 1 to 9, wherein the tyrosine effector domain is derived from, or comprises a polypeptide of, a protein selected from the group consisting of: common gamma chain receptor, common beta chain receptor, IFN alpha receptor, IFN gamma receptor, IFN lambda receptor, IL2/IL15 receptor, IL3 receptor, IL4 receptor, IL5 receptor, IL7 receptor, IL9 receptor, IL10 receptor, IL12 receptor, IL13 receptor, IL20 receptor, IL21 receptor, IL22 receptor, IL23 receptor, IL27 receptor, TSLP Receptor, G-CSF receptor, GM-CSF receptor, CNTF receptor, OSM receptor, LIF receptor, CT-1 receptor, EGFR/HER1, ERBB2/HER2, ERBB3/HER3, ERRB4/HER4, INSR, IGF-1R, IRR, PDGFRA, PDGFRB, CSF-1R, KIT/SCFR, FLK2/FLT3, VEGFR1, VEGFR2, VEGFR3, FGFR-1, FGFR-2, FGFR-3, FGFR-4, CCK4, TRKA, TRKB, TRKC, MET, RON, EPHA1, EPHA2, EPHA3, EPHA4, EPHA5, EPHA6, EPHA7, EPHA8, EPHB1, EPHB2, EPHB3, EPHB4, EPHB5, EPHB6, AXL, MER, TYRO3, TIE, TEK, RYK, DDR1, DDR2, RET, ROS, LTK, ALK, ROR1, ROR2, MUSK, AATYK, AATYK2, AATYK3, RTK106, ALX, BLNK, Grb7, Nsp, SLP-76, SOCS, TSAd, APS, Bam32, Crk, Gads, Grb2, Nck, SLAP, Shc, FRS2, Dab, Dok, IRS, eps8, AFAP110, Gab, ADAP, Carmal, Cas, CIN85, Cortactin, E3B1, Vinexin, SKAP-55, BANK, BCAP, Dof, Paxillin, LAT, LAX, LIME, NTAL, PAG, SIT, and TRIM.

Embodiment 11

The inducible chimeric cytokine receptor of any one of embodiments 1 to 10, wherein the dimerization domain is located at the N-terminus of the inducible chimeric cytokine receptor.

Embodiment 12

The inducible chimeric cytokine receptor of any one of embodiments 1 to 10, wherein the dimerization domain is located at the C-terminus of the inducible chimeric cytokine receptor.

Embodiment 13

The inducible chimeric cytokine receptor of any one of embodiments 1 to 12, wherein the inducible chimeric cytokine receptor comprises a transmembrane domain.

Embodiment 14

The inducible chimeric cytokine receptor of any one of embodiments 1 to 13, wherein the inducible chimeric cytokine receptor comprises a membrane-targeting motif.

Embodiment 15

The inducible chimeric cytokine receptor of embodiment 14, wherein the membrane-targeting motif comprises a CD8 signal sequence or myristoyl.

Embodiment 16

The inducible chimeric cytokine receptor of any one of embodiments 1 to 15, wherein the receptor is myristoylated.

Embodiment 17

The inducible chimeric cytokine receptor of embodiment 1, wherein the dimerization domain comprises an FKBP polypeptide, the tyrosine kinase activating domain comprises an EpoR or TpoR polypeptide, and the tyrosine effector domain comprises an IL7 receptor (IL7R) polypeptide.

Embodiment 18

The inducible chimeric cytokine receptor of embodiment 17, wherein the tyrosine effector domain further comprises an EGFR polypeptide.

Embodiment 19

The inducible chimeric cytokine receptor of embodiment 17, wherein the tyrosine effector domain comprises IL7R (316-459), IL12Rb2(775-825), and/or EGFR(1122-1165).

Embodiment 20

A polynucleotide comprising a nucleic acid sequence encoding the inducible chimeric cytokine receptor of any one of embodiments 1 to 19.

Embodiment 21

An expression vector comprising the polynucleotide of embodiment 20.

Embodiment 22

An engineered immune cell comprising the inducible chimeric cytokine receptor of any one of embodiments 1 to 19 or the polynucleotide of embodiment 20.

Embodiment 23

The engineered immune cell of embodiment 22, wherein the cell further comprises a chimeric antigen receptor (CAR) or a polynucleotide encoding a CAR.

Embodiment 24

The engineered immune cell of embodiment 22 or 23, wherein the immune cell is a T cell.

Embodiment 25

A method of modulating an engineered immune cell in a subject, the method comprising administering a dimeric ligand to a subject that has previously been administered an engineered immune cell of any one of embodiments 22 to 24, wherein the dimeric ligand binds to the dimerization domain of the inducible chimeric cytokine receptor.

Embodiment 26

The method of embodiment 25, wherein the ligand is AP1903.

Embodiment 27

A method of preparing an engineered immune cell, the method comprising introducing a polynucleotide of embodiment 20 or an expression vector of embodiment 21 into the immune cell.

Embodiment 28

An isolated T cell comprising
(i) an inducible chimeric cytokine receptor comprising a dimerization domain, a tyrosine kinase activating domain, and a tyrosine effector domain of a cytokine receptor; and
(ii) a chimeric antigen receptor (CAR) comprising an extracellular ligand-binding domain, a transmembrane domain, and an intracellular signaling domain.

Embodiment 29

The isolated T cell of embodiment 28, wherein the inducible chimeric cytokine receptor is the inducible chimeric cytokine receptor of any one of embodiments 1 to 19.

Embodiment 30

The isolated T cell of embodiment 28 or 29, wherein the isolated T cell exhibits improved in vivo persistence relative to in vivo persistence of a second isolated T cell, wherein the second isolated T cell comprises all components of the isolated T cell except it does not comprise the inducible chimeric cytokine receptor.

Embodiment 31

A method of generating an isolated T cell, wherein the method comprises the steps of:
(a) providing a T cell;
(b) modifying the T cell to express a chimeric antigen receptor (CAR) comprising an extracellular ligand-binding domain, a transmembrane domain, and an intracellular signaling domain; and
(c) modifying the T cell to express an inducible chimeric cytokine receptor.

Embodiment 32

The method of embodiment 31 wherein step c) comprises stably introducing the inducible chimeric cytokine receptor into the cell.

Embodiment 33

The method of embodiment 31 or 32, wherein step c) comprises introducing a polynucleotide that encodes inducible chimeric cytokine receptor to the cell by a transposon/transposase system, a viral-based gene transfer system, or electroporation.

Embodiment 34

The method of any one of embodiments 31 to 33, wherein step b) comprises introducing a polynucleotide that encodes the chimeric antigen receptor to the cell by a transposon/transposase system or a viral-based gene transfer system.

Embodiment 35

The method of embodiment 34, wherein the viral-based gene transfer system comprises recombinant retrovirus or lentivirus.

Embodiment 36

The method of any one of embodiments 31 to 35, wherein step (b) occurs prior to step (c).

Embodiment 37

The method of any one of embodiments 31 to 35, wherein step (c) occurs prior to step (b).

Embodiment 38

A pharmaceutical composition comprising the isolated T cell of any one of embodiments 28 to 30 for use in treating a disorder.

Embodiment 39

The pharmaceutical composition of embodiment 38, wherein the disorder is cancer, autoimmune disease, or infection.

Embodiment 40

The pharmaceutical composition of embodiment 38 or 39, wherein the cells are to be provided more than once.

Embodiment 41

The pharmaceutical composition of embodiment 40, wherein the cells are to be provided to the individual at least about 1, 2, 3, 4, 5, 6, 7, or more days apart.

Embodiment 42

The pharmaceutical composition of embodiment 41, wherein the disorder is a viral disease, a bacterial disease, a cancer, an inflammatory disease, an immune disease, or an aging-associated disease.

Embodiment 43

A method for treating a disorder in a subject, wherein the method comprises administering the isolated T cell of any one of embodiments 28 to 30 to the subject.

Embodiment 44

The method of 43, wherein the cells are provided to the subject more than once.

Embodiment 45

The method of embodiment 43 or 44, wherein the subject has been previously treated with a therapeutic agent prior to administration of the isolated T cell.

Embodiment 46

The method of embodiment 45, wherein the therapeutic agent is an antibody or chemotherapeutic agent.

Embodiment 47

The method of any one of embodiments 43 to 46, wherein the disorder is a viral disease, a bacterial disease, a cancer, an inflammatory disease, an immune disease, or an aging-associated disease.

Embodiment 48

The method according to embodiment 47, wherein the cancer is a hematological malignancy or a solid cancer.

Embodiment 49

The method according to embodiment 48, wherein the hematological malignancy is selected from acute lymphoblastic leukemia (ALL), acute myeloid leukemia (AML), chronic myelogenous leukemia (CML), chronic eosinophilic leukemia (CEL), myelodysplasia syndrome (MDS), non-Hodgkin's lymphoma (NHL), or multiple myeloma (MM).

Embodiment 50

The method according to embodiment 49, wherein the solid cancer is selected from biliary cancer, bladder cancer, bone and soft tissue carcinoma, brain tumor, breast cancer, cervical cancer, colon cancer, colorectal adenocarcinoma, colorectal cancer, desmoid tumor, embryonal cancer, endometrial cancer, esophageal cancer, gastric cancer, gastric adenocarcinoma, glioblastoma multiforme, gynecological tumor, head and neck squamous cell carcinoma, hepatic cancer, lung cancer, malignant melanoma, osteosarcoma, ovarian cancer, pancreatic cancer, pancreatic ductal adenocarcinoma, primary astrocytic tumor, primary thyroid cancer, prostate cancer, renal cancer, renal cell carcinoma, rhabdomyosarcoma, skin cancer, soft tissue sarcoma, testicular germ-cell tumor, urothelial cancer, uterine sarcoma, or uterine cancer.

EXAMPLES

Example 1A: Inducible Chimeric Cytokine Receptors

Figure 2:
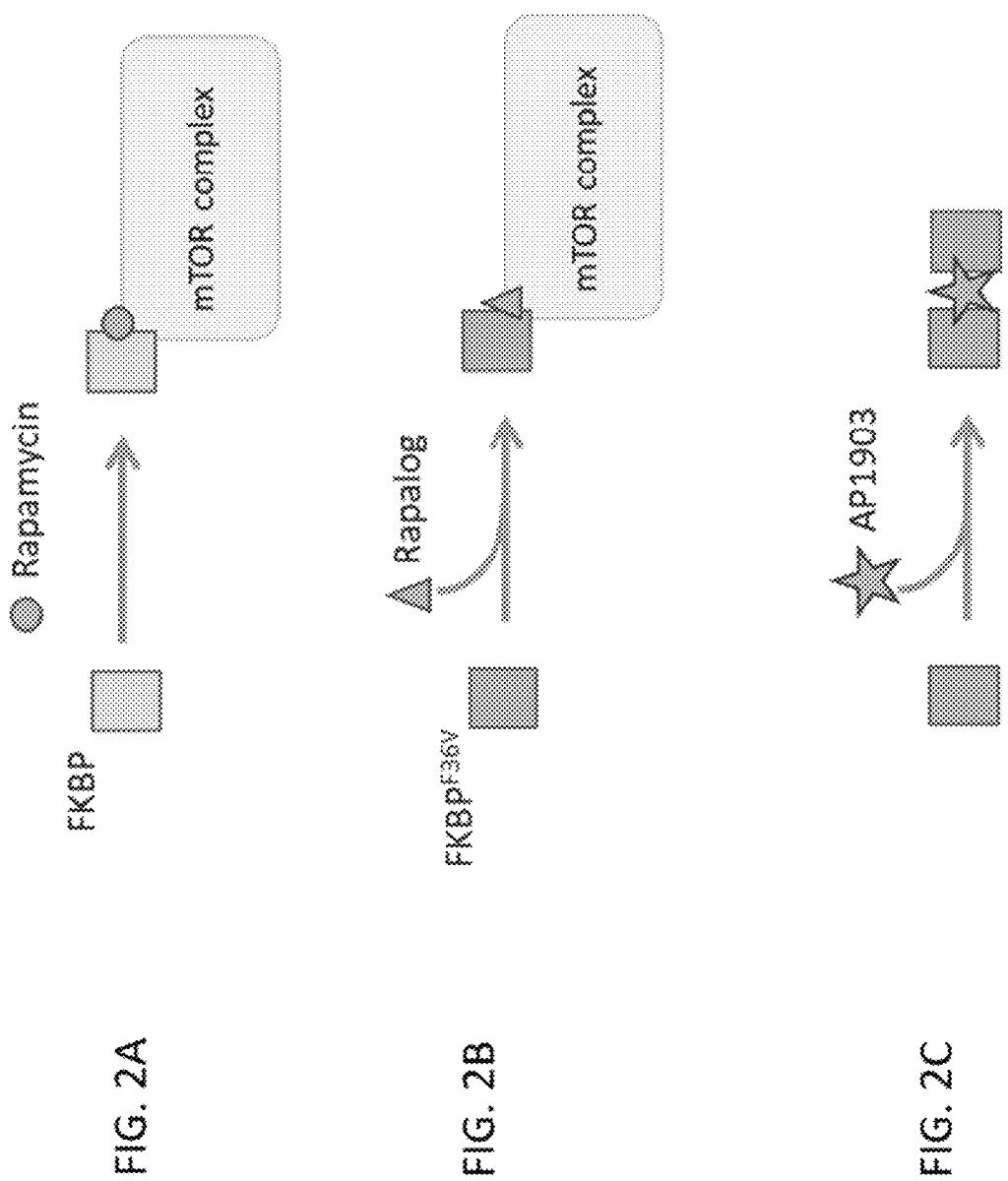
FIG. 2A depicts a schematic diagram of FKBP binding rapamycin to inhibit mTOR.
FIG. 2B depicts a schematic diagram of $FKBP^{F36V}$ binding to rapamycin-like compounds.
FIG. 2C depicts a schematic diagram of AP1903 dimerizing $FKBP^{F36V}$.

Cytokines known to enhance T cell persistence and function, such as IL-2, IL-7 and IL-15, signal through natural heterodimeric cytokine receptors that in turn activate JAK1 and JAK3 kinases (exemplary activation of JAK kinases is shown in FIG. 1). Inducible chimeric cytokine receptors (FIG. 1) were designed and demonstrated to be efficacious in regulating cytokine signaling in CAR-T cells (Examples infra). The AP1903-inducible chimeric cytokine receptor is an AP1903-responsive $FKBP^{F36V}$ fusion protein. Endogenous FKBP binds rapamycin to inhibit mTOR (FIG. 2A). $FKBP^{F36V}$ binds to rapamycin-like compounds (Rapalogs) (FIG. 2B). AP1903 is a clinically-safe rapalog dimer that dimerizes $FKBP^{F36V}$ (FIG. 2C).

Figure 3:
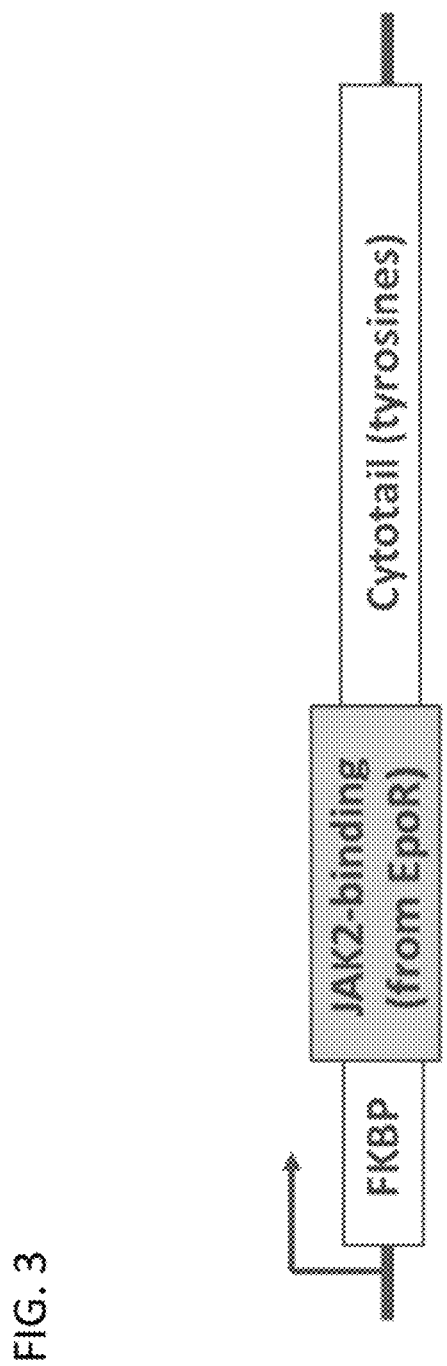
FIG. 3 depicts a schematic diagram of an exemplary inducible chimeric cytokine receptor.

Of more than forty known cytokine receptors, there are five homodimers. These five homodimers couple to JAK2. JAK2 activates as a homodimer. One exemplary embodiment of an inducible chimeric cytokine receptor provided herein is shown in FIG. 3.

To utilize AP1903 with a variety of different receptors, heterodimeric cytokine receptors are converted into homodimers.

In some embodiments, FKBP is located at the N-terminus of an inducible chimeric cytokine receptor. In other embodiments, FKBP is located at the C-terminus of an inducible chimeric cytokine receptor. In some embodiments, an inducible chimeric cytokine receptor provided herein has a transmembrane domain. In other embodiments, an inducible chimeric cytokine receptor provided herein lacks a transmembrane domain. In some embodiments, an inducible chimeric cytokine receptor provided herein is myristoylated. In other embodiments, an inducible chimeric cytokine receptor provided herein is not myristoylated.

Example 2: Comparison of Small-Molecule Inducible Epo Receptors

This example illustrates efficacy of various inducible chimeric cytokine receptors provided herein.

In this study, the following inducible chimeric cytokine receptors tested for activity:

a.
(SEQ ID NO: 1)
CD8 SS-Myc-FKBP(F36V)-EpoR(237-508; L241G, L242P)-V5 b.
V5-EpoR(273-508)

c.
V5-EpoR(273-508)-FKBP(F36V)

d.
V5-EpoR(273-508)-FKBP(E31G, F36V, R71G, K105E)

e.
Myristoyl-V5-EpoR(273-508)-FKBP(F36V)

f.
Myristoyl-V5-EpoR(273-508)-FKBP(E31G, F36V, R71G, K105E)

g.
(SEQ ID NO 2)
V5-EpoR(273-508)-FKBP(F36V)-FKBP(F36V)

h.
(SEQ ID NO: 3)
V5-EpoR(273-508)-FKBP(E31G, F36V, R71G, K105E)-FKBP(E31G, F36V, R71G, K105E)

i.
CD8 SS-Myc-FKBP(F36V)-CD8(138-206)-EpoR(273-508)-V5 j.
FKBP(F36V, L106P)-FKBP(F36V, L106P)-EpoR(273-508)-V5

-continued k.
FKBP(F36V, L106P)-EpoR(273-508)-V5 l.
FKBP(F36V)-EpoR(273-508)-V5 m.
FKBP(F36V)-FKBP(F36V)-EpoR(273-508)-V5

According to the construct name, receptors contain a membrane-targeting motif (CD8 signal sequence (CD8 SS) or myristoyl), a dimerization domain (FKBP(F36V) or mutants thereof), a portion of the EpoR that contains a transmembrane (EpoR(237-272)), a JAK2 binding motif (EpoR(273-338)), and/or a tyrosine effector domain (EpoR (339-508)). Constructs may also include epitope tags (Myc or V5) for western blot or flow analyses.

Figure 4:
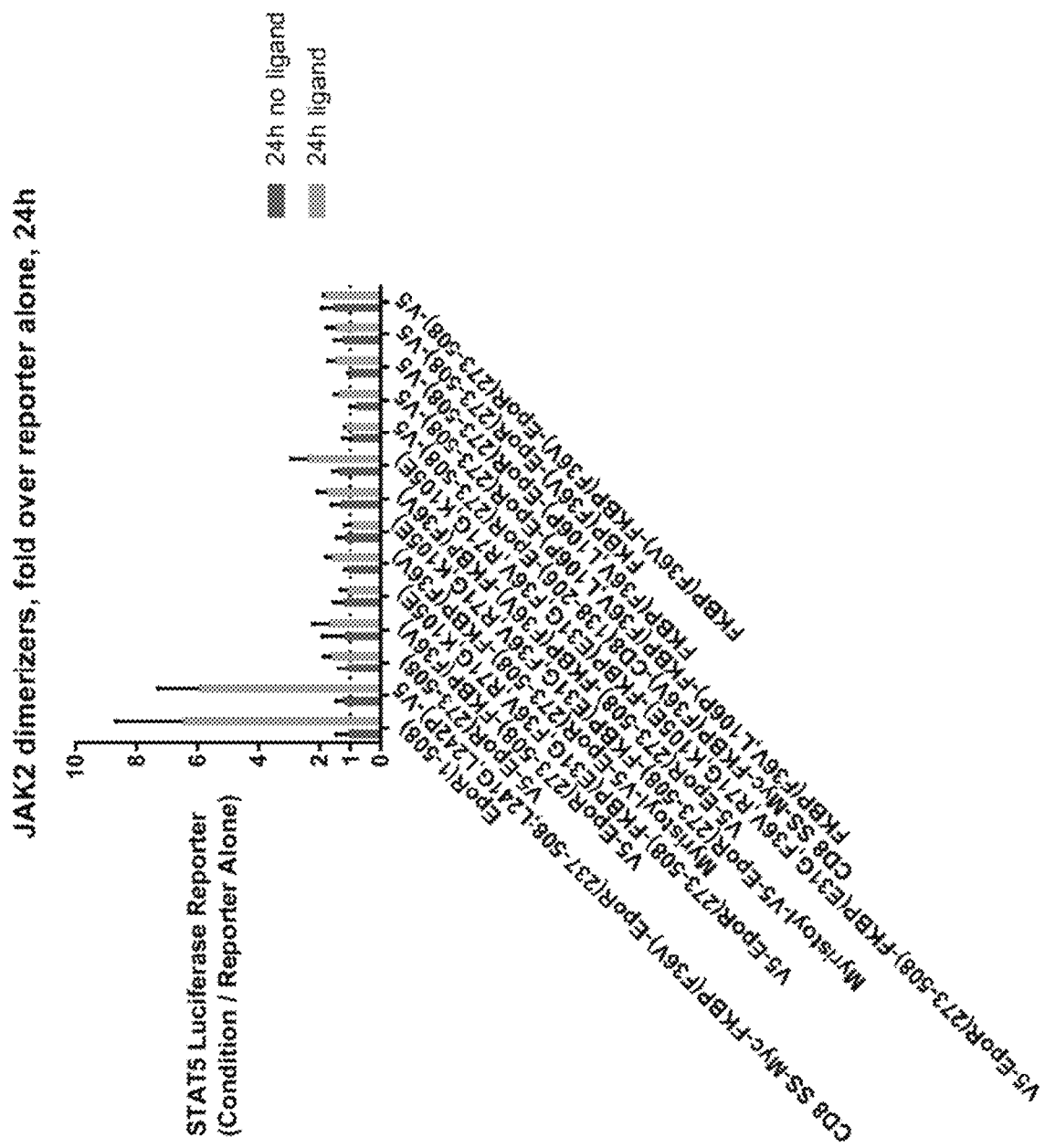
FIG. 4 depicts a bar graph summarizing results of a STAT5 assay testing function of the indicated inducible chimeric cytokine receptors.

Vectors encoding the inducible chimeric cytokine receptors were transfected into HEK293T cells along with a luciferase reporter for the STAT5 transcription factor (Promega E4651). The reporter vector consists of a firefly luficerase expressed under the control of a STAT5 responsive DNA element. Upon addition of erythropoietin (Epo), the erythropoietin receptor (EpoR) activates the JAK2 kinase which then phosphorylates tyrosines on the EpoR cytotail to generate binding sites for STAT5. Bound STAT5 is then phosphorylated, activating STAT5 to engage DNA motifs and promote transcription. Epo was added to samples with cells transfected with EpoR, and AP1903 was added to the samples with cells transfected with fusions of the EpoR to FKBP. No Epo or AP1903 was added to samples to assess baseline signaling. Results of the STAT5 assay are summarized in FIG. 4. In FIG. 4, "ligand" is either Epo or AP1903.

Signaling of CD8 SS-Myc-FKBP(F36V)-EpoR(237-508; L241G, L242P)-V5, was the closest to the EpoR(1-508) positive control (FIG. 4).

These results demonstrate that certain AP1903-inducible chimeric cytokine receptors can effectively signal upon dimerization by AP1903 to activate a reporter. AP1903-inducible chimeric cytokine receptor construct CD8 SS-Myc-FKBP(F36V)-EpoR(237-508; L241G, L242P)-V5 demonstrated robust activity.

Example 3A: Chimeric Small-Molecule Inducible Epo Receptors to Generate IL2, IL7, IL12, IL21, and IFNa/b Signals By changing the tyrosine effector domain (cytotail) of the chimeric cytokine receptor (e.g. CD8 SS-Myc-FKBP (F36V)-EpoR(237-338; L241G, L242P)-Cytotail XYZ), the receptor can be redirected to signaling of choice. The inducible chimeric cytokine receptors tested utilized the CD8 SS membrane-targeting motif, the FKBP(F36V) dimerization domain, the EpoR(237-338; L241 G, L242P) tyrosine kinase activating domain, and tyrosine effector domains from either the EpoR, GHR, IL2Rb, IL7R, IL12Rb2, IL21R, IFNAR2, or IFNLR1 receptors. A negative control lacking the JAK2 binding motifs and tyrosine effector tail is included CD8 SS-Myc-FKBP(F36V)-EpoR (237-282; L241G, L242P). The following inducible chimeric cytokine receptors were tested in this study:

a.
(SEQ ID NO 1)
CD8 SS-Myc-FKBP(F36V)-EpoR(237-338; L241G, L242P)-

EpoR(339-508)-V5 b.
(SEQ ID NO 4)
CD8 SS-Myc-FKBP(F36V)-EpoR(237-338; L241G, L242P)-

GHR(353-638)

c.
(SEQ ID NO 5)
CD8 SS-Myc-FKBP(F36V)-EpoR(237-338; L241G, L242P)-

IL2Rb(333-551)

d.
(SEQ ID NO 6)
CD8 SS-Myc-FKBP(F36V)-EpoR(237-338; L241G, L242P)-

IL7R(316-459)

e.
(SEQ ID NO 7)
CD8 SS-Myc-FKBP(F36V)-EpoR(237-338; L241G, L242P)-

IL12Rb2(714-862)

f.
(SEQ ID NO 8)
CD8 SS-Myc-FKBP(F36V)-EpoR(237-338; L241G, L242P)-

IL12Rb2(775-825)

g.
(SEQ ID NO 9)
CD8 SS-Myc-FKBP(F36V)-EpoR(237-338; L241G, L242P)-

IL21R(322-538)

h.
(SEQ ID NO 410)
CD8 SS-Myc-FKBP(F36V)-EpoR(237-338; L241G, L242P)-

IFNAR2(310-515)

i.
(SEQ ID NO 11)
CD8 SS-Myc-FKBP(F36V)-EpoR(237-338; L241G, L242P)-

IFNLR1(300-520)

HEK293 cells were transiently transfected with constructs encoding the above inducible chimeric cytokine receptors above, and a luciferase reporter for the indicated pathway. Cells were treated with ligand for 24 h. Results are summarized in FIG. 5A. In this study, the "control dimerizer" is a tail-less construct.

Figure 5A:
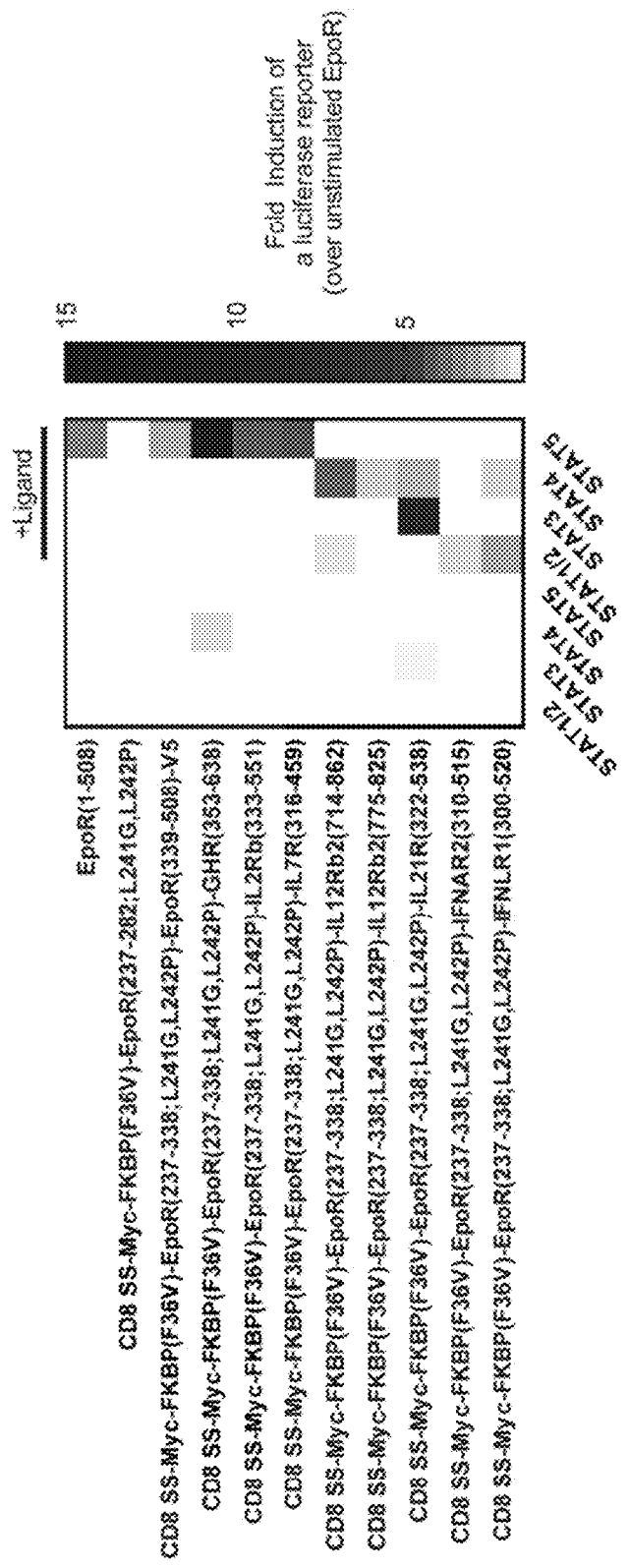
FIG. 5A depicts a graph summarizing results of a cell-based reporter assay testing function of the indicated inducible chimeric cytokine receptors.

In FIG. 5A, the black boxes induction >5 fold. All STAT4 experiments were done with co-transfection of STAT4.

Example 3B: An Intact JAK-Binding Domain and Phosphorylatable Tyrosines in the Cytotail Domain are Necessary for Signaling To identify components essential for the inducible chimeric cytokine receptor to signal, we generated FKBP switches that lacked either the JAK-binding domains or tyrosine residues in the cytotail domain. Specifically, either one or both JAK-binding motifs from TpoR(478-582) were replaced with glycine linkers, or all or a single (i.e. Y449) tyrosine residue(s) in the IL7R(316-459) cytotail was mutated to phenylalanine. The term "switch" as used in the Example section refers to the inducible chimeric cytokine receptor. For example, an "FKBP switch" as used herein is an inducible chimeric cytokine receptor comprising FKBP as the dimerization domain.

A HEK293T cell reporter assay was used to test how each of these domains affected cytokine signaling. Briefly, 20,000 HEK293T cells were plated into each well of a poly-L- lysine-coated 96-well flat-bottom plate and allowed to adhere overnight. A chimeric cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with the indicated concentrations of AP1903 (Apex Bio) diluted in serum-free media, and Stat reporter activity was determined 5 hours post-treatment using the Dual-Glo Luciferase Assay System (Promega). The FKBP switch bearing two intact JAK-binding motifs from TpoR(478-582) and the unmutated IL7R(316-459) was used as a positive control. As a negative control (i.e. Mock transfected), cells were transfected with all components with the exception of the chimeric cytokine receptor. Fold induction of Stat reporter activity was normalized to that of HEK293T cells transfected with all vectors except for the inducible cytokine receptor and that were left untreated. Triplicate wells were set up for each condition.

Figure 5B:
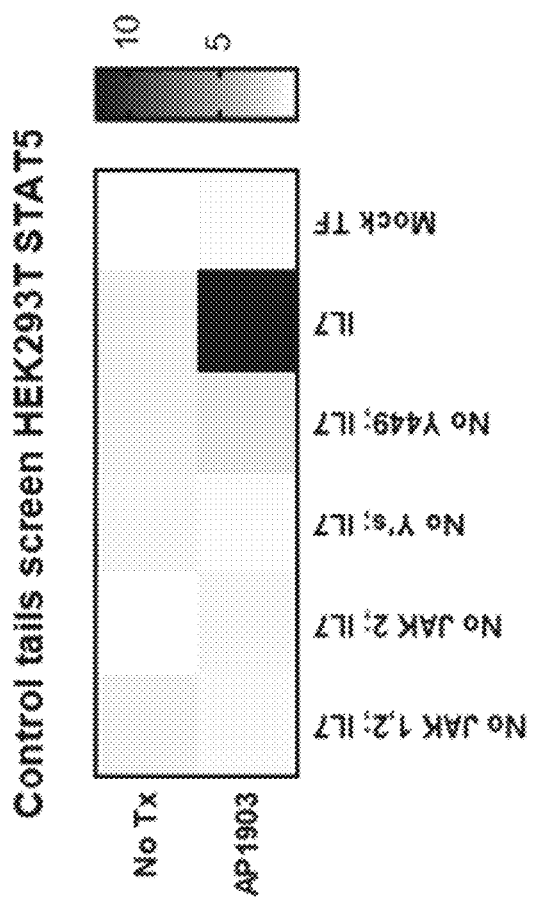
FIG. 5B depicts a graph summarizing results of a cell-based reporter assay testing function of the indicated inducible chimeric cytokine receptors.

FIG. 5B shows Stat5 reporter activity of the FKBP switch lacking the indicated domains following AP1903 treatment. Compared to the positive control, the removal of one (i.e. No JAK 2; IL7) or both (i.e. No JAK 1,2; IL7) JAK-binding motifs abrogated AP1903-induced Stat5 reporter activity. Similarly, the mutation of all 3 tyrosine residues in the IL7R(317-459) cytotail to phenylalanine abrogated AP1903-induced Stat5 reporter activity. In this example, Y499 in the IL7R(317-459) cytotail was identified as the key tyrosine residue that mediated Stat5 activation.

Example 4: Murine Receptors for Syngeneic Studies

Murine versions of the engineered inducible receptors were generated. As FKBP is highly conserved, the FKBP (F36V) sequence was not changed. However, the transmembrane and JAK2 binding portions of mouse EpoR, and the tyrosine effector domains of mouse IL2Rb and IL7R receptors were used. The following inducible chimeric cytokine receptors were tested in this study:

a.
(SEQ ID NO 12)
CD8 SS-Myc-FKBP(F36V)-muEpoR(236-337; L264G,

L265P)-muIL2Rb(337-539)

b.
(SEQ ID NO 13)
CD8 SS-Myc-FKBP(F36V)-muEpoR(236-337; L264G,

L265P)-muIL7R(316-459)

Vectors encoding the inducible chimeric cytokine receptors were transfected into HEK293T cells along with a luciferase reporter for STAT5, and dimerizer for the indicated pathway was added. Results are summarized in FIG. 6.

Figure 6:
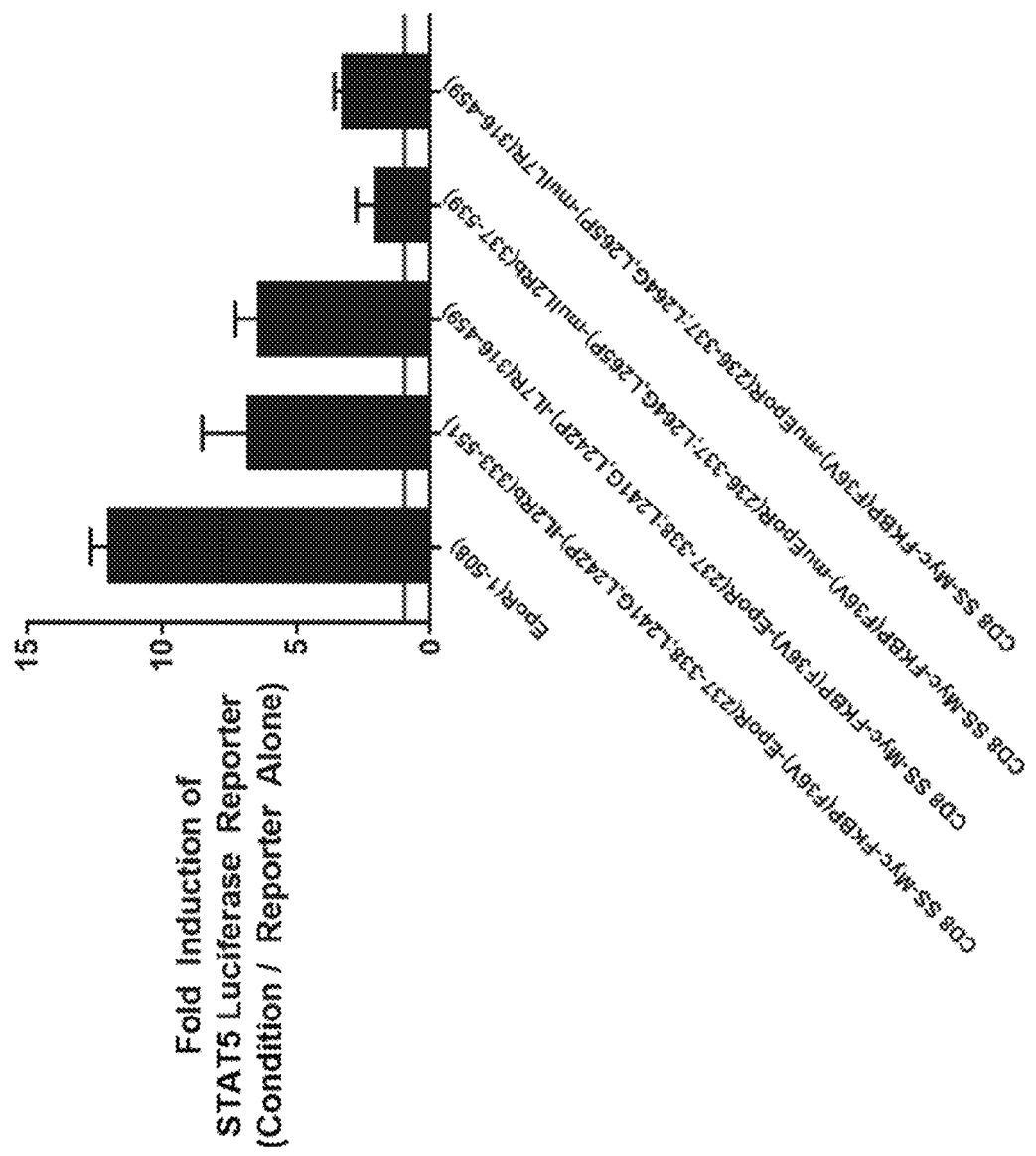
FIG. 6 depicts a graph summarizing results of a cell-based reporter assay testing function of the indicated inducible chimeric cytokine receptors.

The murine constructs were able to signal (6 h of ligands on transiently transfected HEK293 cells) (FIG. 6).

Example 5A: Inducible Chimeric Cytokine Receptors with Improved Signaling

In another study, the EpoR portion of the previous design (FKBP-EpoRm TM-EpoR JAK box-cytotail) was replaced with comparable domains of other homodimeric cytokine receptors. To identify transmembrane domains that exhibit stronger and/or faster signaling, an early time point where the EpoR dimerizer signals poorly (6-8 h, right image) was selected.

For this study, several tyrosine kinase activating domains were compared using a otherwise identical inducible cytokine receptor design. The tyrosine effector domain consists of a STAT5-activating sequence from IL7R fused to a STAT4-activating sequence from IL12Rb2. Each construct contains a membrane-targeting motif (CD8 SS), a dimerization domain (FKBP(F36V)), a tyrosine kinase activating domain derived from either the EpoR, GP130, PrlR, GHR, GCSFR, or TPOR/MPLR receptors, and a tyrosine effector domain consisting of the IL7R(316-459) cytotail fused to the IL12Rb2(775-825) peptide. Chimeric cytokine receptors also include an epitope tag for detection (Myc). The following inducible chimeric cytokine receptors were tested in this study:

a.
(SEQ ID NO 14)
CD8 SS-Myc-FKBP(F36V)-EpoR(237-338; L241G, L242P)-

IL7R(316-459)-IL12Rb2(775-825)

b.
(SEQ ID NO 15)
CD8 SS-Myc-FKBP(F36V)-GP130(609-700)-IL7R(316-

459)-IL12Rb2(775-825)

c.
(SEQ ID NO 16)
CD8 SS-Myc-FKBP(F36V)-PrlR(221-319)-IL7R(316-459)-

IL12Rb2(775-825)

d.
(SEQ ID NO 17)
CD8 SS-Myc-FKBP(F36V)-GHR(251-352)-IL7R(316-

459)-IL12Rb2(775-825)

e.
(SEQ ID NO 18)
CD8 SS-Myc-FKBP(F36V)-GCSFR(614-710)-IL7R(316-

459)-IL12Rb2(775-825)

f.
(SEQ ID NO 19)
CD8 SS-Myc-FKBP(F36V)-TPOR/MPLR(478-582)-

IL7R(316-459)-IL12Rb2(775-825)

Figure 7:
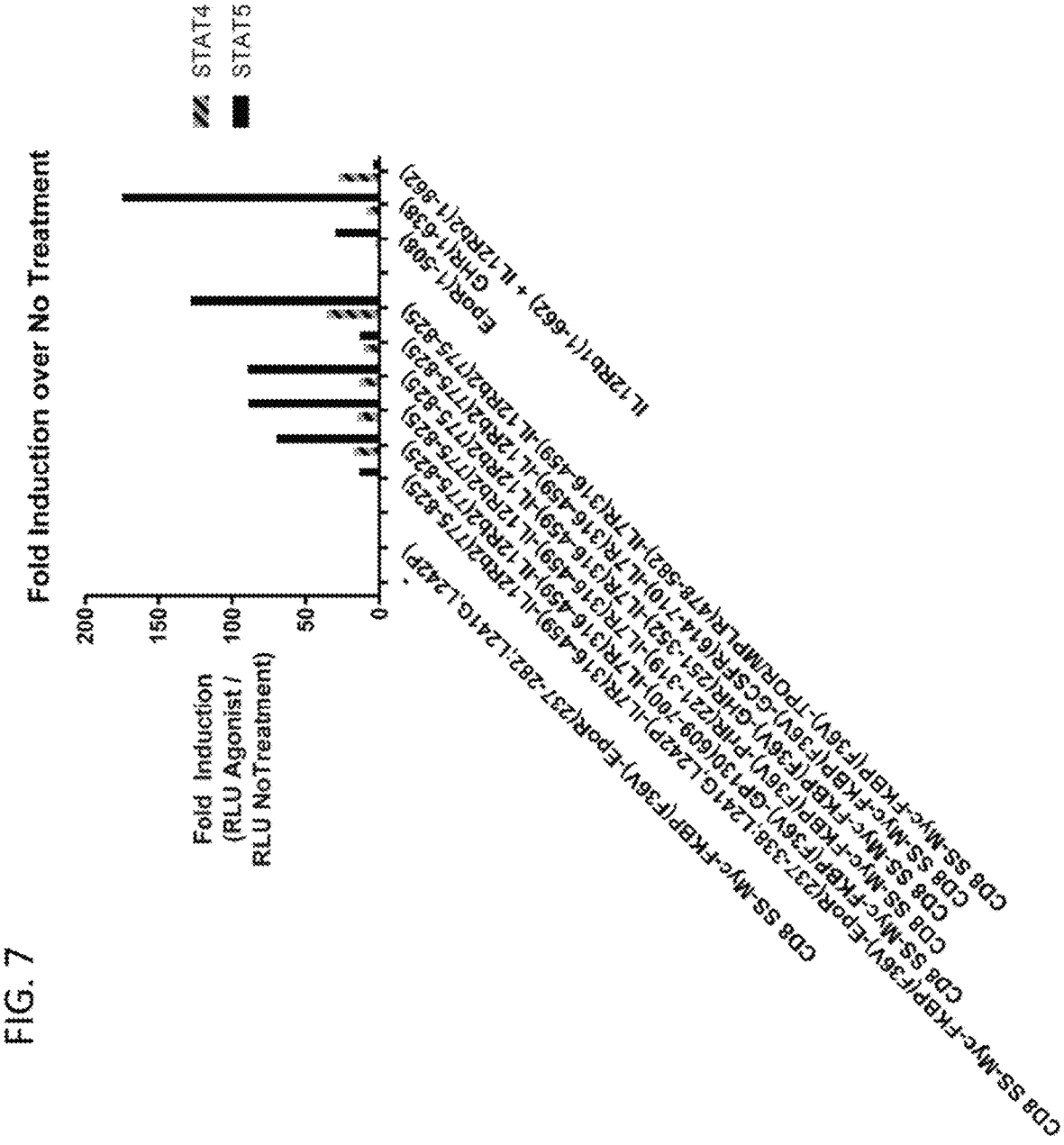
FIG. 7 depicts a graph summarizing results of a cell-based reporter assay testing function of the indicated inducible chimeric cytokine receptors.
Figure 8:
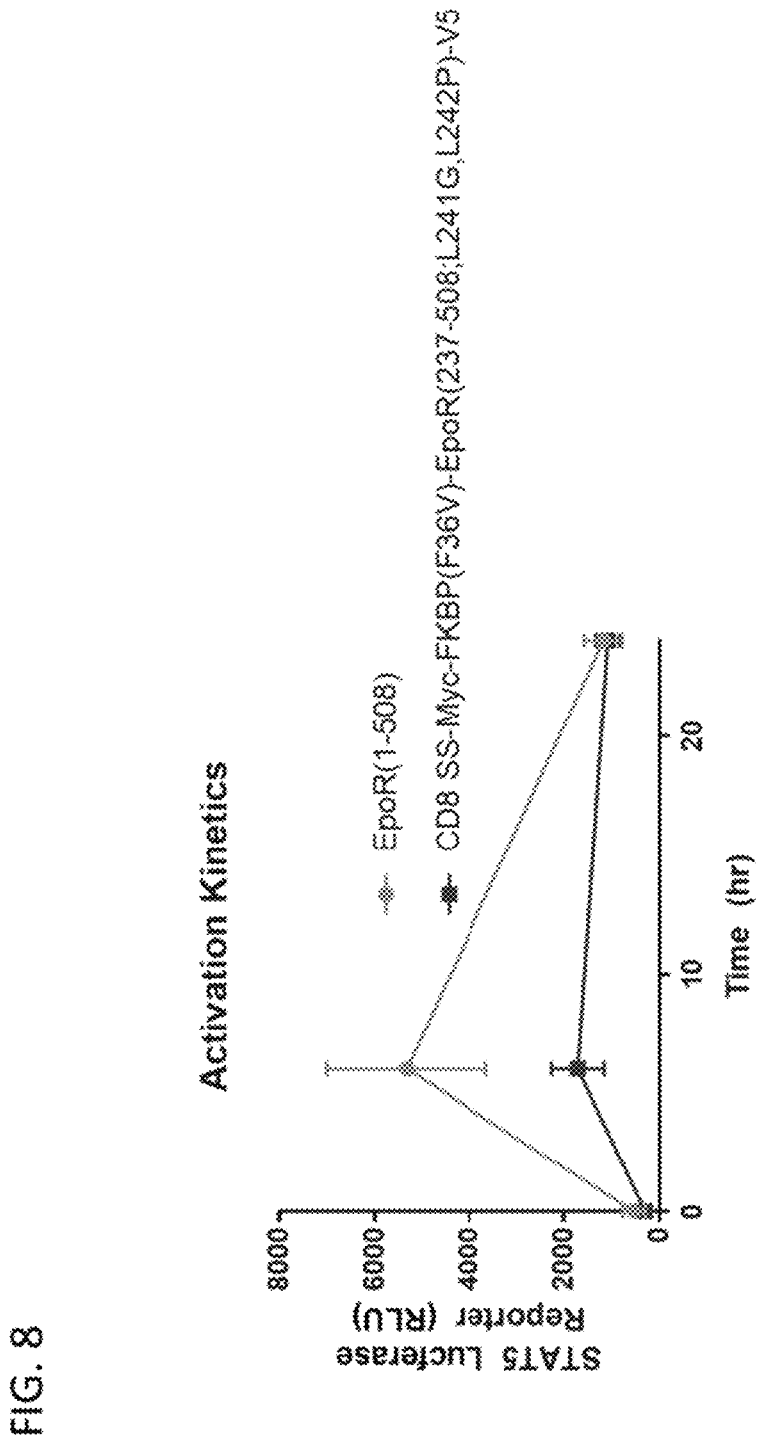
FIG. 8 depicts a graph summarizing results of a cell-based reporter assay testing function of the indicated inducible chimeric cytokine receptor.

HEK293 cells were transfected with constructs encoding the above inducible chimeric cytokine receptors, and a luciferase reporter for either STAT4 or STAT5. The luciferase reporters (Promega) encoded a luciferase under the control of either a STAT4 or STAT5 responsive element. As HEK293 cells lack STAT4, in wells transfected with the STAT4 reporter, a plasmid encoding constitutively-expressed STAT4 was transfected as well added. Transfected EpoR, GHR, and IL12Rb1+IL12Rb2 (the IL12 receptor) were used as positive controls. Results are summarized in FIGS. 7, 8, 9, and 10A. The ligand added to inducible chimeric cytokine receptors was AP1903. Epo was added to EpoR transfected cells, Growth Hormone to GHR transfected cells, and IL-12 to IL12 receptor transfected cells The tyrosine kinase activating domain with EpoR components was the weakest signaling construct (FIG. 7). The greatest fold induction of both STAT5 and STAT4 was achieved by a TPOR/MPLR-based dimerizer: CD8 SS-Myc- FKBP(F36V)-TPOR/MPLR(478-582)-IL7R(316-459)-IL12Rb2(775-825) (SEQ ID NO 19) (FIG. 7).

The EpoR-based cytokine receptor (CD8 SS-Myc-FKBP (F36V)-EpoR(237-338; L241G, L242P)-IL7R(316-459)-IL12Rb2(775-825) (SEQ ID NO 14)) demonstrated the lowest basal signaling (essentially equivalent to reporter alone). The GCSFR construct (CD8 SS-Myc-FKBP(F36V)-GCSFR(614-710)-IL7R(316-459)-IL12Rb2(775-825) (SEQ ID NO 18)) had the strongest signaling for STAT4 (FIG. 9) but had basal signaling.

Example 5B: Optimizing Potency of Signaling Output by Modulating Ectodomain Affinity To determine if the responsiveness/sensitivity of the inducible chimeric cytokine receptor may be tuned by modulating the affinity of the ectodomain to its ligand, we generated FKBP switches that signaled through the same JAK-binding domains and cytotails, but with FKBP ectodomain variants that had reduced affinities to AP1903.

A HEK293T cell reporter assay was used to test how ectodomain affinity affected the responsiveness of cytokine signaling. Briefly, 20,000 HEK293T cells were plated into each well of a poly-L-lysine-coated 96-well flat-bottom plate and allowed to adhere overnight. An chimeric cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with the indicated concentrations of AP1903 (Apex Bio) diluted in serum-free media, and Stat reporter activity was determined 5 hours post-treatment using the Dual-Glo Luciferase Assay System (Promega). Fold induction of Stat reporter activity was normalized to that of HEK293T cells transfected with all vectors except for the inducible cytokine receptor and that were left untreated. Triplicate wells were set up for each condition.

Figure 10A:
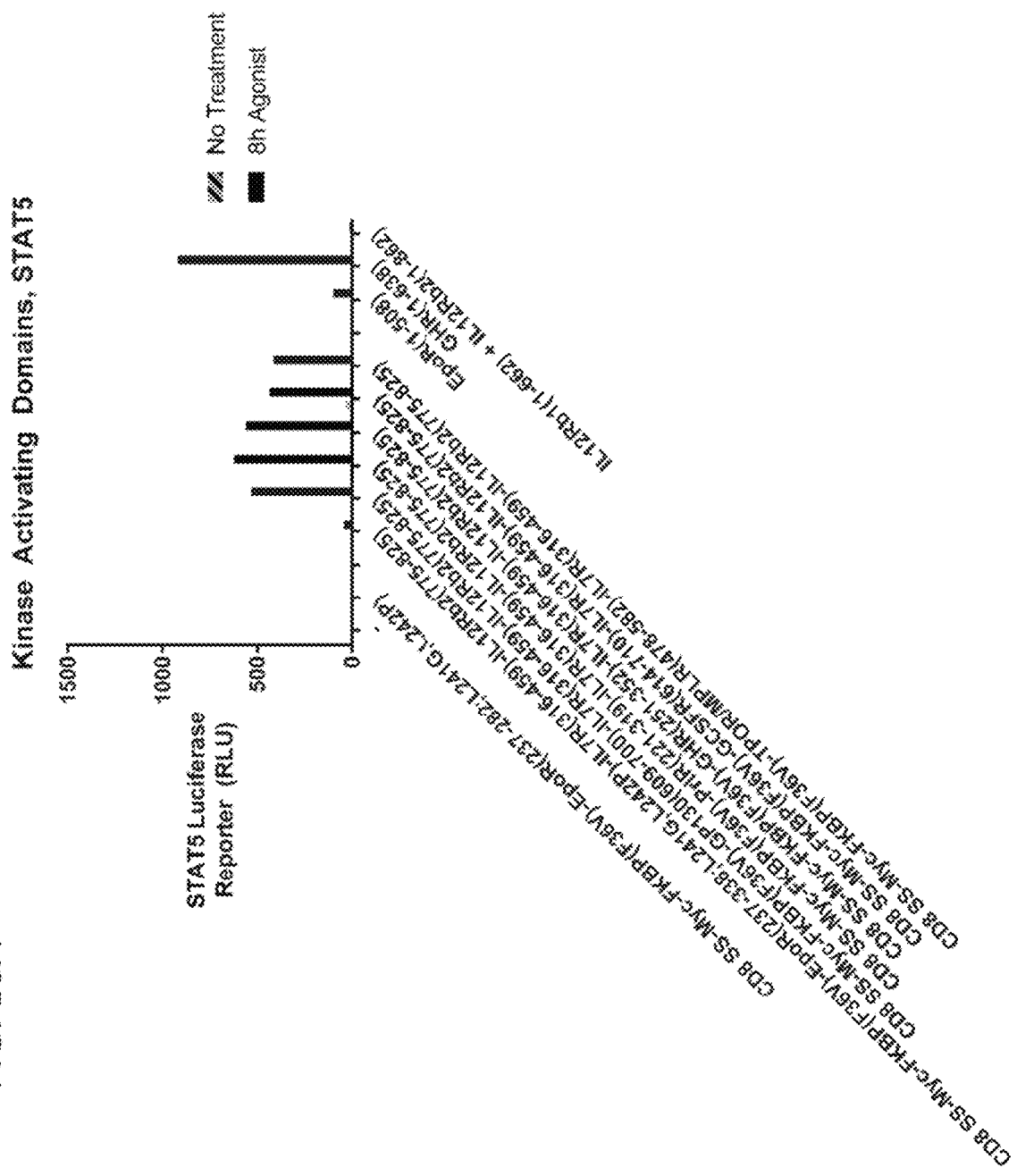
FIG. 10A depicts a graph summarizing results of a cell-based reporter assay testing function of the indicated inducible chimeric cytokine receptors.
Figure 10B:
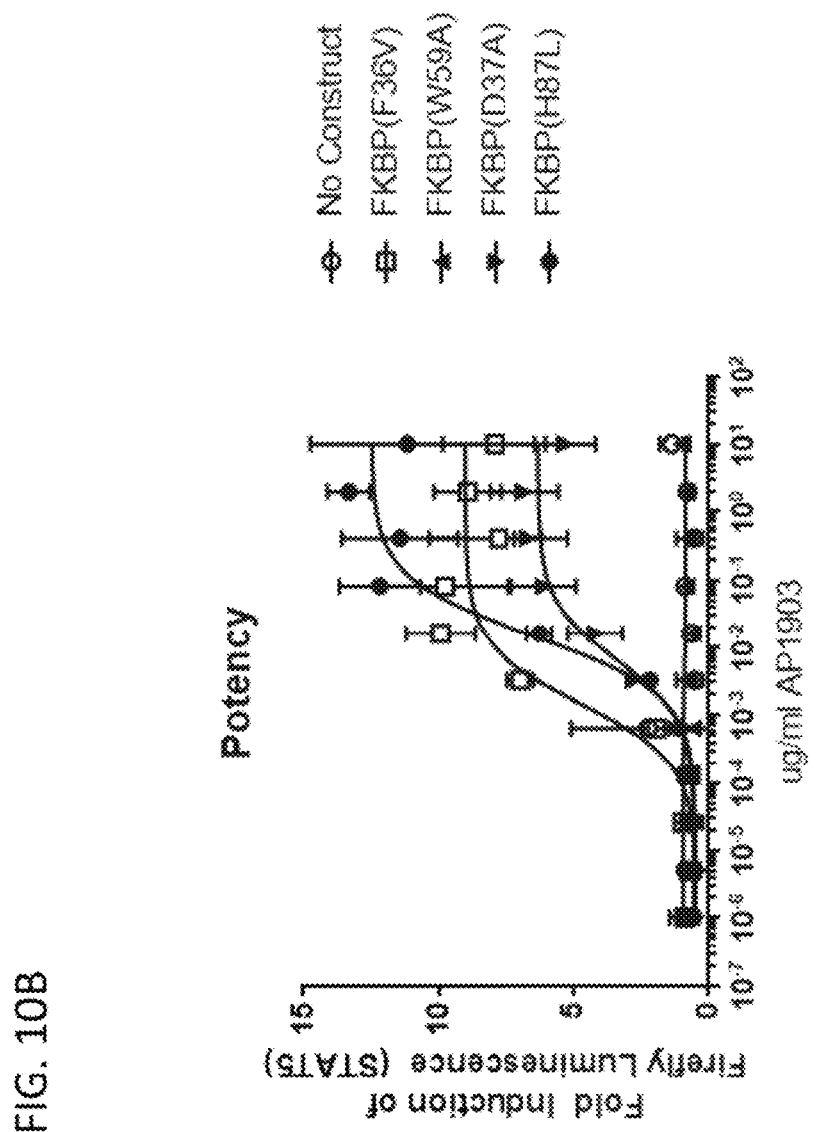
FIG. 10B depicts a graph summarizing results of a cell-based reporter assay testing function of the indicated inducible chimeric cytokine receptors.

FIG. 10B shows Stat5 reporter activity of FKBP switch ectodomain variants in response to AP1903. Compared to the high-affinity FKBP(F36V) mutants, other FKBP variants that weakened the affinity of FKBP for AP1903 also increased the EC50 for Stat5 induction.

Example 5C: An Alternative Approach for Engineering Chimeric Cytokine Receptors with Improved Signaling Capabilities Traditional approaches of designing chimeric cytokine receptors involve fusing the extracellular ligand-binding domain of one receptor to the transmembrane and intracellular signaling domains of a second receptor (Mol Ther. 2014 June; 22(6):1211-1220; Mol Ther. 2017 Jan. 4; 25(1):249-258; Nat Commun. 2018 May 23; 9(1):2034.). We devised an alternative approach, in which we leverage the transmembrane and JAK-binding domains derived from certain cytokine receptors that (i) signal as homodimers in their natural form and (ii) retain the ability to signal well as a chimera when coupled to a different ectodomain (i.e. those described in FIG. 7). In our approach, the transmembrane and intracellular JAK-binding domain of one receptor is fused to the "cytotail" (i.e. the region after the JAK-binding domain) of a second receptor.

In FIG. 7, the TpoR TM and JAK binding domain generated the strongest signal-to-noise output. Therefore, we generated TpoR-based cytokine receptor chimeras using the traditional approach by fusing the extracellular domain of TpoR (TpoR/MPLR(1-478)) to the transmembrane and intracellular domain of a different cytokine receptor. We also generated analogous chimeras using our approach by fusing the region including the TpoR transmembrane and JAK2-binding domains (i.e. TpoR(478-582)), before fusion with the cytotails of a different cytokine receptor. As a positive control, we used a vector that encodes the full-length (FL) TpoR.

A HEK293T cell reporter assay was used to test the inducibility and magnitude of cytokine signaling. Briefly, 20,000 HEK293T cells were plated into each well of a poly-L-lysine-coated 96-well flat-bottom plate and allowed to adhere overnight. An chimeric cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, treated with 100 ng/ml TPO, or with 10 ug/mL AP1903 (Apex Bio) diluted in serum-free media. Fold induction of Stat reporter activity was normalized to that of HEK293T cells transfected with all vectors except for the inducible cytokine receptor and that were left untreated. Triplicate wells were set up for each condition.

Figure 10C:
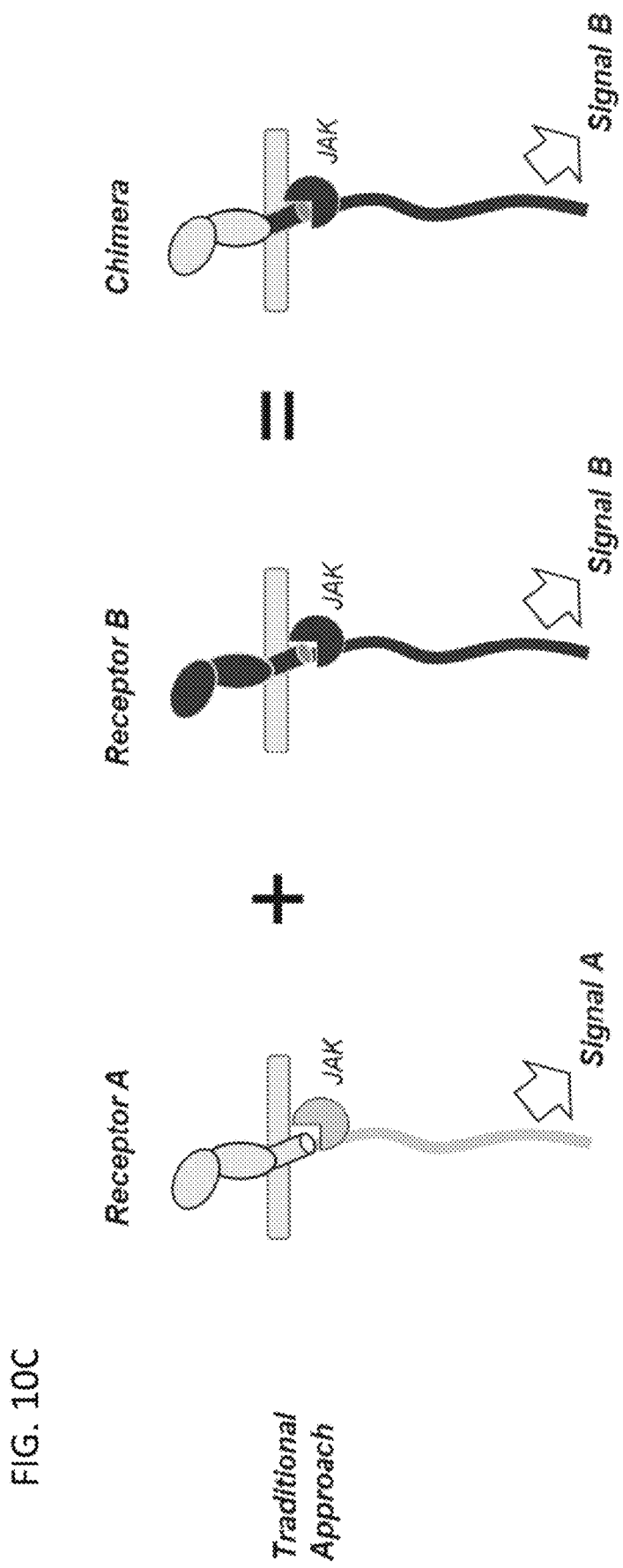
FIG. 10C depicts a schematic showing the traditional approach of engineering chimeric cytokine receptors.
Figure 10D:
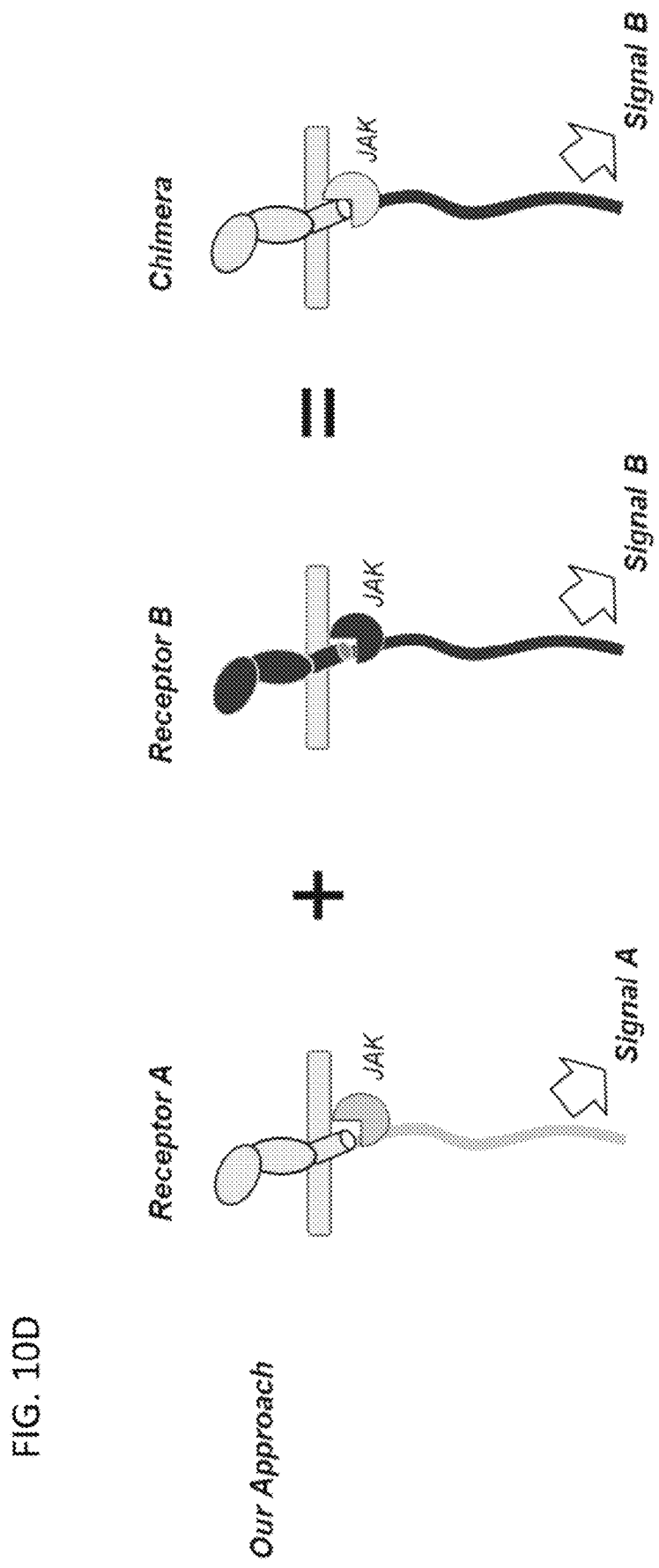
FIG. 10D depicts a schematic showing the approach used in the present disclosure for engineering chimeric cytokine receptors.

FIGS. 10C and 10D show a schematic comparing and contrasting the traditional approach of chimeric cytokine receptor engineering against ours. While the traditional approach (FIG. 10C) fuses only the ectodomain of Receptor A to the transmembrane domain, JAK-binding domain and cytotail of Receptor B, our approach (FIG. 10D) fuses the ectodomain, transmembrane domain and JAK-binding domain of Receptor A to the cytotail of Receptor B.

Figure 10E:
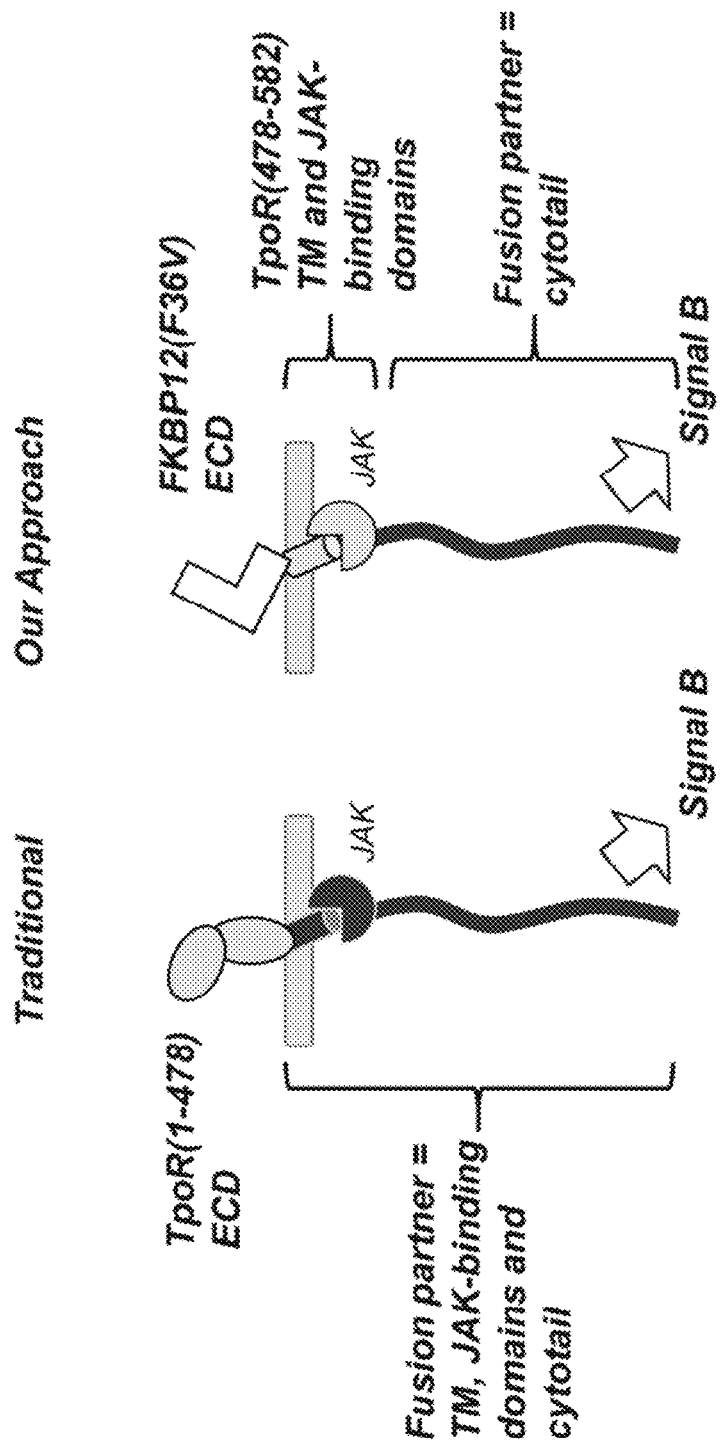
FIG. 10E depicts a schematic of the chimeric receptors tested in a cell-based reporter assay in Example 5C.
Figure 10F:
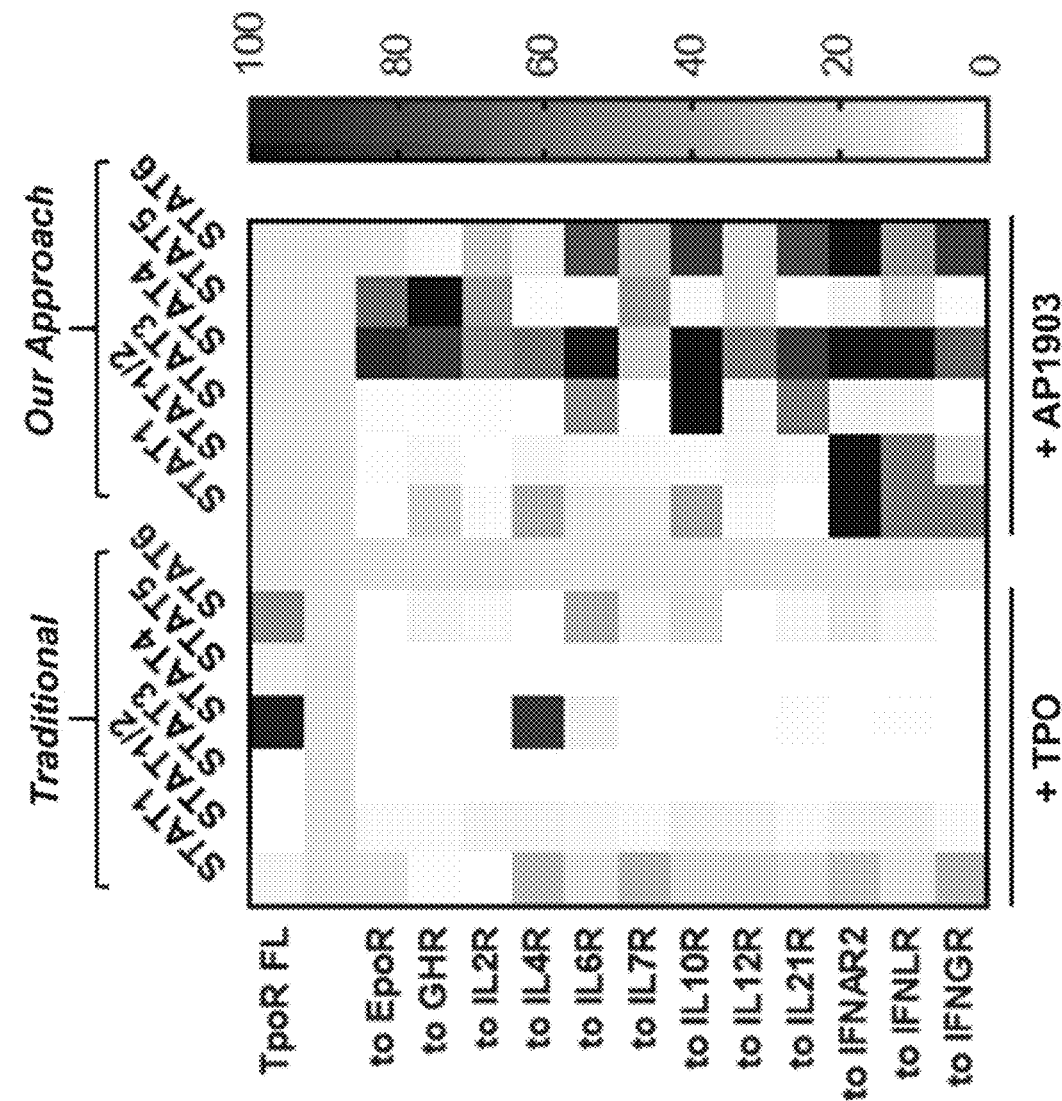
FIG. 10F depicts a graph summarizing results of a cell-based reporter assay testing function of the indicated inducible chimeric cytokine receptors.

FIG. 10E shows a schematic of the chimeric receptors tested in FIG. 10F.

FIG. 10F shows a heatmap summarizing results from the Stat reporter assay. Each row represents the respective fusion partner; each column represents the respective Stat-responsive Firefly Luciferase reporter. Each box depicts a fold induction, each column is normalized to the highest fold induction of the respective Stat reporter: 2.75 fold for STAT1, 13.5 fold for STAT1/2, 354 fold for STAT3, 38 fold for STAT4, 173 fold for STAT5, and 10.5 fold for STAT6. Compared to chimeric cytokine receptors based on the traditional design, those engineered using our approach showed a greater magnitude of downstream signaling in response to the inducer AP1903.

Example 6: Inducible Chimeric Cytokine Receptors

This example illustrates inducible chimeric cytokine receptors with improved and specialized functions.

In some embodiments, cytokine tails can be linked in tandem to stimulate multiple pathways (e.g., the IL7R(316-459)-IL12Rb2(775-825) fragment fusion for pro-persistence STAT5 and pro-inflammatory STAT4). That is, in this embodiment, cytokine tails from at least two receptors were used. In some other embodiments, a cytokine tail from a single receptor was used.

Minimal Tyrosine Effector Domains with STAT5 or AP-1 Outputs

For each cytotail, small tyrosine peptides are responsible for a signaling pathway. Relevant motifs were identified to develop substantially smaller constructs with improved signaling. For example, a IL12Rb2(775-825)peptide containing Y800 was determined to be sufficient to provide STAT4 signaling when used as a tyrosine effector domain (see Examples 3 and 5).

In this study, IL2Rb, IL7R, and EGFR cytotails were analyzed to identify tyrosines sufficient for key aspects of signaling. For instance, a segment of IL2Rb containing the STAT5-interacting tyrosines Y418 and Y436 might retain STAT5 signaling, but may lose PI3K signaling as this requires Y364 of the IL2Rb cytotail. Inducible chimeric cytokine receptors comprising the IL7R, IL2Rb, and IFNAR2 tails may include one or more tyrosine motifs within the cytotails. Elimination of one or more portions of the tail (e.g., the IL12Rb2 tail) in some cases results in removal of negative regulatory motifs and stronger signaling.

In this study, signaling by a variety of IL7Ra and IL2Rb derived fragments using the EpoR-based tyrosine kinase activating domain were tested. The following inducible chimeric cytokine receptors were tested in this study:

a.
(SEQ ID NO 6)
CD8 SS-Myc-FKBP(F36V)-EpoR(237-338; L241G, L242P)-
IL7R(316-459)

b.
(SEQ ID NO 20)
CD8 SS-Myc-FKBP(F36V)-EpoR(237-338; L241G, L242P)-
IL7R(376-416)

c.
(SEQ ID NO 21)
CD8 SS-Myc-FKBP(F36V)-EpoR(237-338; L241G, L242P)-
IL7R(424-459)

d.
(SEQ ID NO 22)
CD8 SS-Myc-FKBP(F36V)-EpoR(237-338; L241G, L242P)-
IL7R(376-416, 424-459)

e.
(SEQ ID NO 23)
CD8 SS-Myc-FKBP(F36V)-EpoR(237-338; L241G, L242P)-
IL7R(424-459; Y456F)

f.
(SEQ ID NO 24)
CD8 SS-Myc-FKBP(F36V)-EpoR(237-338; L241G, L242P)-
IL7R(376-416, 424-459; Y456F)

g.
(SEQ ID NO 5)
CD8 SS-Myc-FKBP(F36V)-EpoR(237-338; L241G, L242P)-
IL2Rb(333-551)

h.
(SEQ ID NO 25)
CD8 SS-Myc-FKBP(F36V)-EpoR(237-338; L241G, L242P)-
IL2Rb(393-433)

i.
(SEQ ID NO 26)
CD8 SS-Myc-FKBP(F36V)-EpoR(237-338; L241G, L242P)-
IL2Rb(518-551)

j.
(SEQ ID NO 27)
CD8 SS-Myc-FKBP(F36V)-EpoR(237-338; L241G, L242P)-
IL2Rb(339-379, 393-433)

k.
(SEQ ID NO 28)
CD8 SS-Myc-FKBP(F36V)-EpoR(237-338; L241G, L242P)-
IL2Rb(339-379, 518-551)

l.
(SEQ ID NO 29)
CD8 SS-Myc-FKBP(F36V)-EpoR(237-338; L241G, L242P)-
IL2Rb(393-433, 518-551)

m.
(SEQ ID NO 30)
CD8 SS-Myc-FKBP(F36V)-EpoR(237-338; L241G, L242P)-
IL2Rb(339-379, 393-433, 518-551)

IFNAR2 constructs were tested but did not initiate substantial signals with short (8 h) AP1903 treatment using the CD8 SS membrane-targeting motif, the FKBP(F36V) dimerization domain and the EpoR(237-339; L241G, L242P) tyrosine kinase activating domain. Constructs that are plotted include tyrosine effector domains derived from the IL7R and IL2Rb cytotails.

Figure 11:
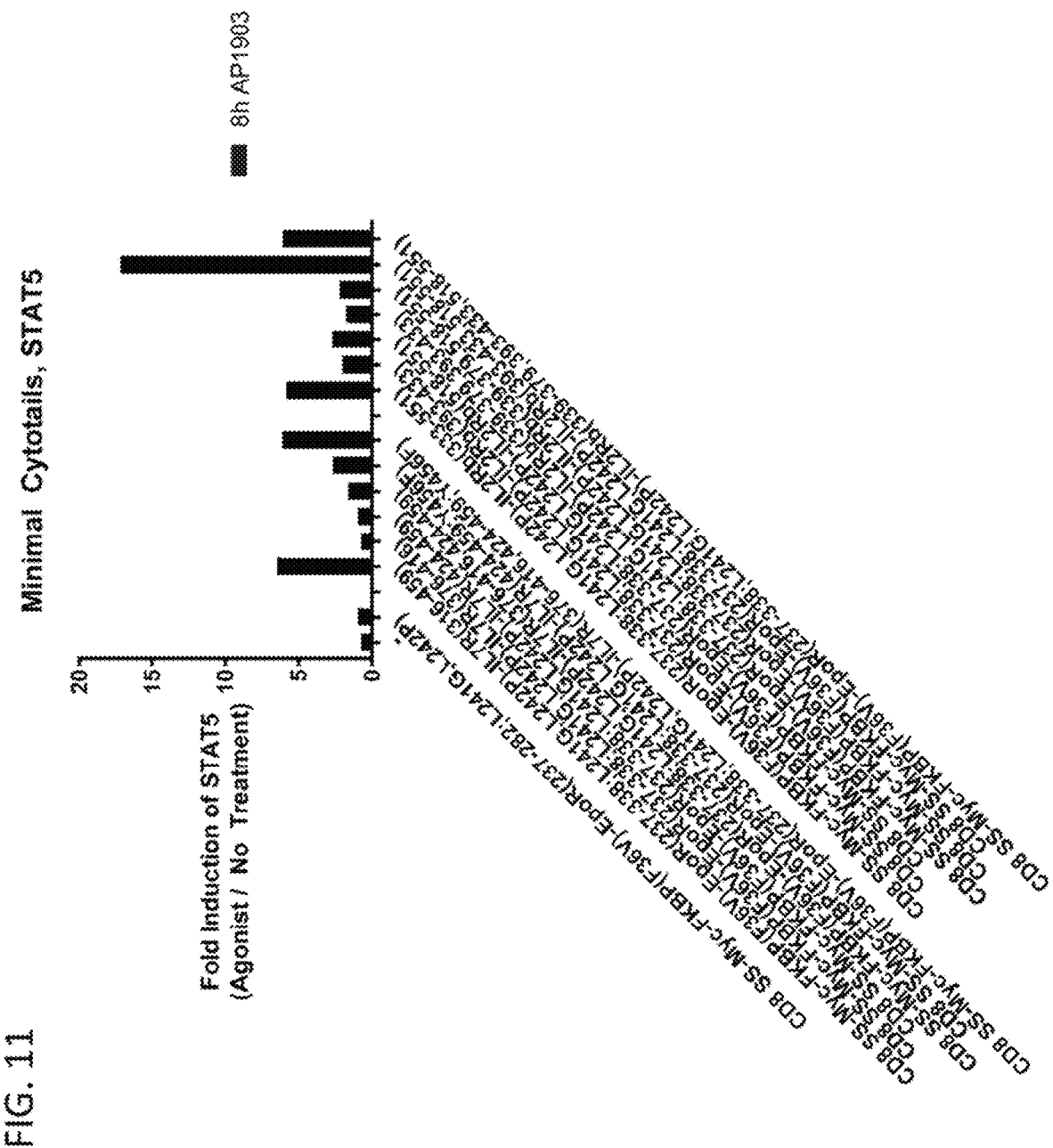
FIG. 11 depicts a graph summarizing results of a cell-based reporter assay testing function of the indicated inducible chimeric cytokine receptors.

IL7 signaling through STAT5 was fully recreated by two fragments containing Y401 and Y449 but without the negative regulatory Y456 (IL7R(376-416, 424-459; Y456F); SEQ ID NO: 24; FIG. 11). IL2 STAT5 signaling was recreated by two fragments containing Y364, Y418, and Y436, but far greater signaling was observed with a smaller construct lacking Y364 (IL2Rb(393-433, 518-551); SEQ ID NO: 29; FIG. 11). Y364 is reported to activate PI3K, which promotes T cell differentiation and proliferation and re-organizes the actin skeleton to promote receptor internalization. Thus Y364 is both a negative regulatory motif for STAT5 signaling, and the key positive regulatory motif for PI3K/AKT/TORC axis. Depending on the desired functional output, Y364 can be included or excluded.

Non-Cytokine Receptors

Figure 12:
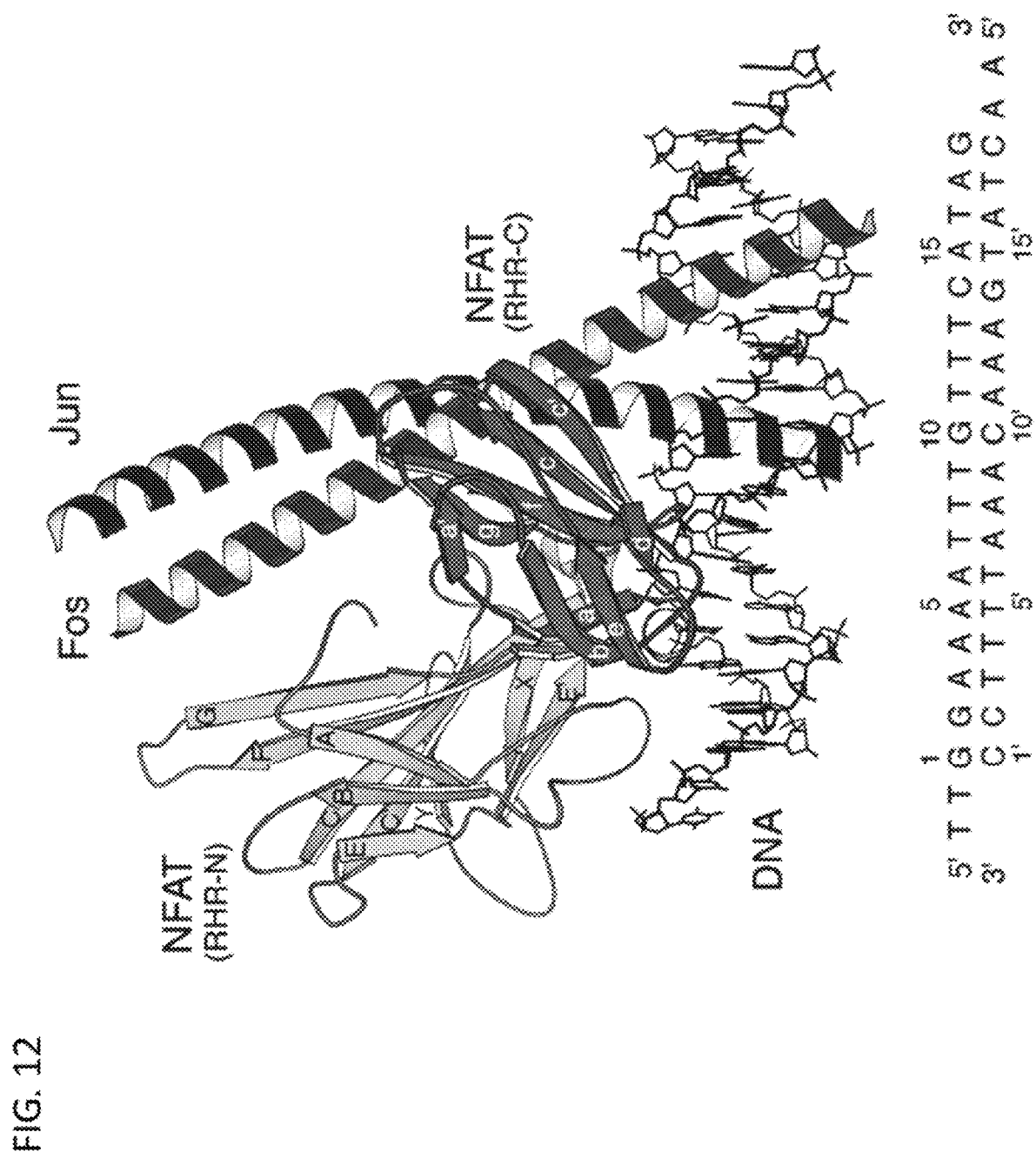
FIG. 12 depicts a schematic illustration of NFAT with AP-1 binding to a promoter sequence.
Figure 13:
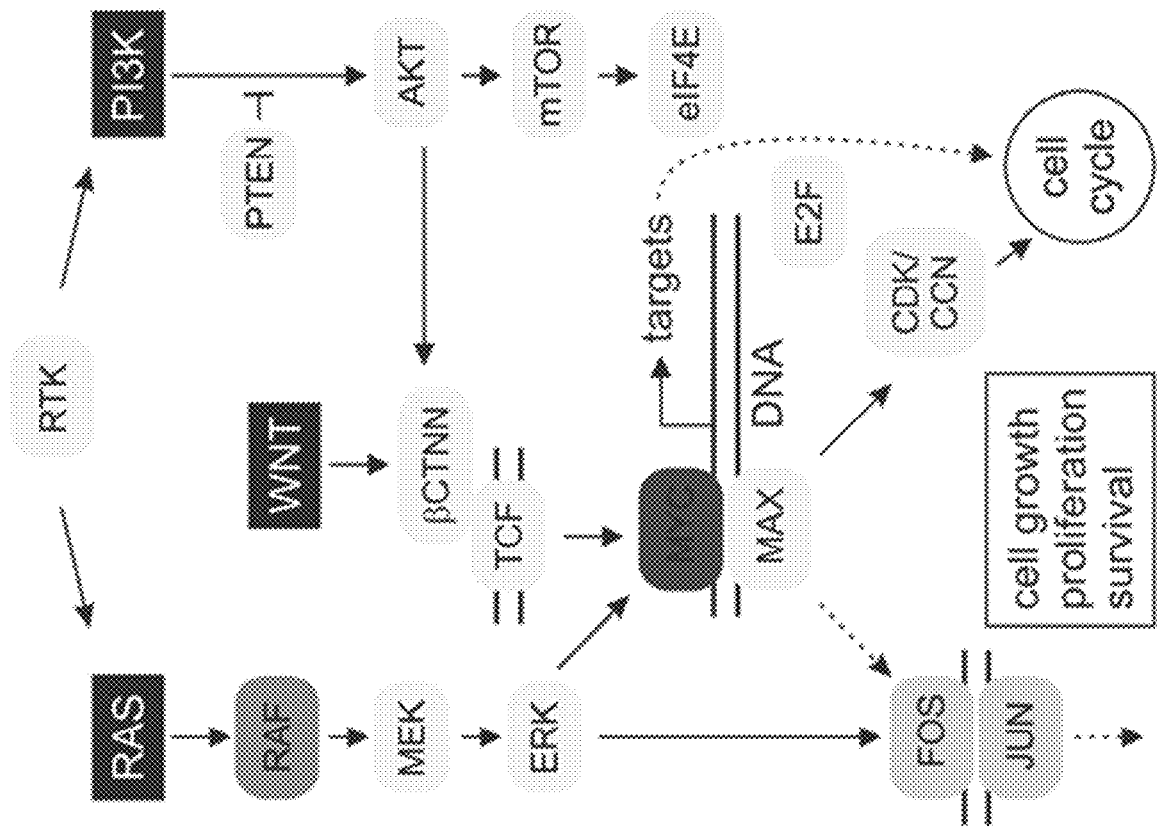
FIG. 13 depicts a schematic diagram of the MEK/ERK pathway leading to upregulation of Fos through Myc/Max.

Upon TCR activation, Ca+ mobilization leads to activation of NFAT and upregulation of pro-inflammatory targets (IL2, GzmB, etc.). Many of these promoters are activated not by NFAT alone but rather a heterotrimer of NFAT with AP-1 (coiled-coil of Fos and Jun) (FIG. 12). Exhaustion occurs with excessive antigen stimulation, and is thought to occur when the amount of activated NFAT supersedes the amount of AP-1 resulting in NFAT homo-dimers and activation of different promoters. One way to prevent exhaustion would be to increase the amount of AP-1 (Fos/Jun) (FIG. 13). Cytokine receptors such as IL2R and IL7R activate JNK (Jun Kinases) that phosphorylate and activate c-Jun. However, this alone is insufficient to upregulate AP-1 as Fos must also be upregulated and phosphorylated. The parallel MEK/ERK pathway leads to upregulation of Fos through Myc/Max, as well as direct phosphorylation of Fos.

AP-1 is induced by coordinated JNK and ERK signaling. In some embodiments, inducible chimeric cytokine receptors capable of activating JNK and/or MEK/ERK are provided herein. In some embodiments, an inducible chimeric cytokine receptor can potently induce AP-1 to prevent exhaustion.

Constructs encoding the following inducible chimeric cytokine receptors were tested for activity. Each construct contains of a membrane-targeting motif (CD8 SS), a dimerization domain (FKBP(F36V)), a tyrosine kinase activating domain (EpoR(237-338; L241G, L242P)), and a tyrosine effector domain derived from the cytotail of the RTK EGFR or a cytokine receptor. Chimeric cytokine receptors also include an epitope tag for detection (Myc):

a.
(SEQ ID NO 31)
CD8 SS-Myc-FKBP(F36V)-EpoR(237-338; L241G, L242P)-

EGFR(955-1186)

b.
(SEQ ID NO 32)
CD8 SS-Myc-FKBP(F36V)-EpoR(237-338; L241G, L242P)-

EGFR(955-1044, 1058-1186; Y974F)

c.
(SEQ ID NO 33)
CD8 SS-Myc-FKBP(F36V)-EpoR(237-338; L241G, L242P)-

EGFR(955-1009; Y974F)

d.

e.
(SEQ ID NO 34)
CD8 SS-Myc-FKBP(F36V)-EpoR(237-338; L241G, L242P)-

EGFR(1019-1085)

f.
(SEQ ID NO 35)
CD8 SS-Myc-FKBP(F36V)-EpoR(237-338; L241G, L242P)-

EGFR(1037-1044, 1058-1103; Y1068/1101F)

g.
(SEQ ID NO 36)
CD8 SS-Myc-FKBP(F36V)-EpoR(237-338; L241G, L242P)-

EGFR(1066-1118; Y1068/1086F)

h.
(SEQ ID NO 37)
CD8 SS-Myc-FKBP(F36V)-EpoR(237-338; L241G, L242P)-

EGFR(1122-1165)

i.
(SEQ ID NO 38)
CD8 SS-Myc-FKBP(F36V)-EpoR(237-338; L241G, L242P)-

EGFR(1133-1186; Y1148F)

j.
(SEQ ID NO 5)
CD8 SS-Myc-FKBP(F36V)-EpoR(237-338; L241G, L242P)-

IL2Rb(333-551)

k.
(SEQ ID NO 6)
CD8 SS-Myc-FKBP(F36V)-EpoR(237-338; L241G, L242P)-

IL7R(316-459)

l.
(SEQ ID NO 7)
CD8 SS-Myc-FKBP(F36V)-EpoR(237-338; L241G, L242P)-

IL12Rb2(714-862)

m.
(SEQ ID NO 9)
CD8 SS-Myc-FKBP(F36V)-EpoR(237-338; L241G, L242P)-

IL21R(322-538)

n.
(SEQ ID NO 410)
CD8 SS-Myc-FKBP(F36V)-EpoR(237-338; L241G, L242P)-

IFNAR2(310-515)

Figure 14:
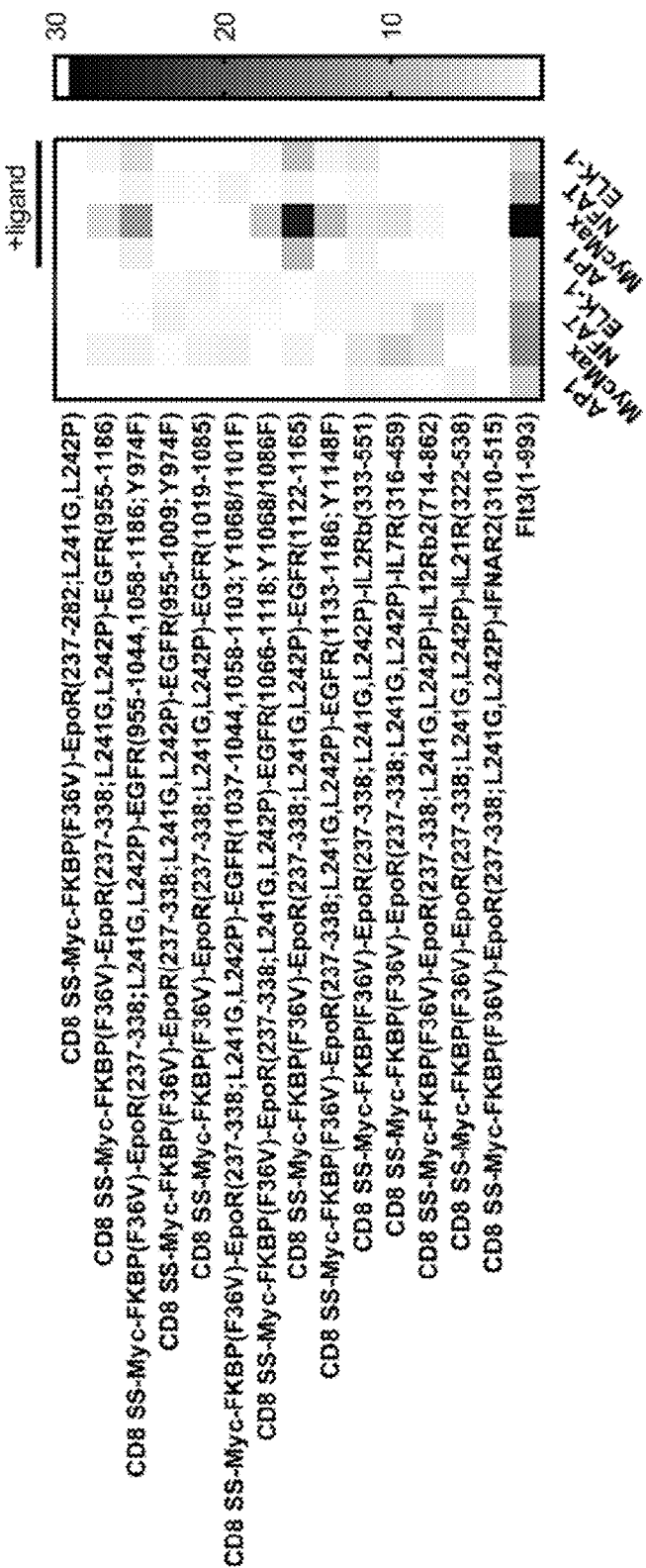
FIG. 14 depicts a graph summarizing results of a cell-based reporter assay testing function of the indicated inducible chimeric cytokine receptors.

HEK293 cells were transiently transfected with the above constructs a luciferase reporter for the indicated pathway. STAT5 signaling was measured. Results are summarized in FIG. 14. The ligand for all chimeric antigen receptors is AP1903. The darkest boxes represent induction >10 fold. FLT ligand was added to transfected Flt3 receptor tyrosine kinase. Transfected Flt3 receptor was used as a control instead of EGFR as HEK293 cells express endogenous EGFR receptor.

Receptors that Activate PLC→NFkB

One drawback of allogeneic CAR-T cells is that the TCR knockout or knockdown (to prevent GvHD) results in a loss of basal TCR signaling. Basal TCR signaling increases TCR persistence. Although cytokines can increase persistence through STAT5, this does not replicate TCR exactly. The TCR mobilizes $Ca^{2+}$ to activate PLC leading to NFAT and NFkB.

The small molecule inducible chimeric cytokine receptors provided herein have been engineered to mobilize calcium and activate NFAT and NFkB.

Figure 15:
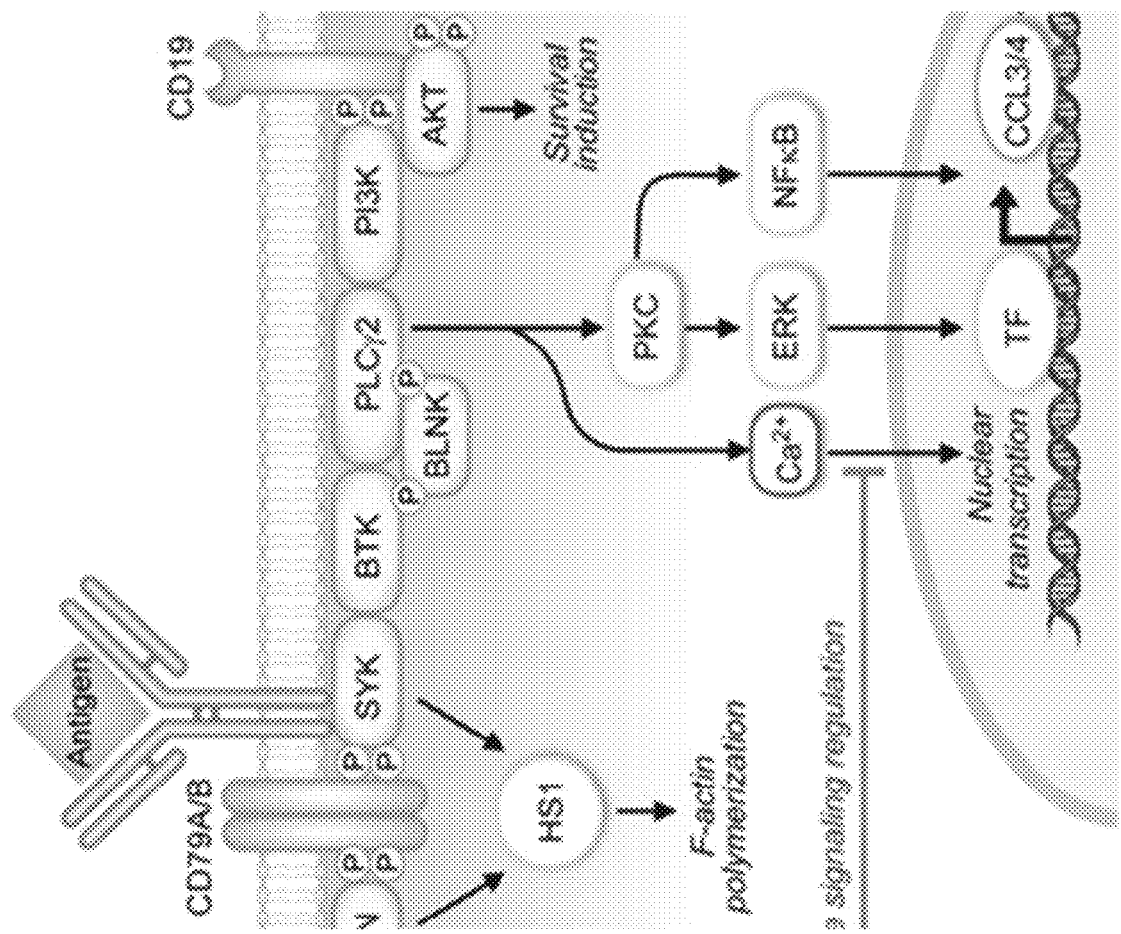
FIG. 15 depicts a schematic diagram of the BTK pathway.

The B cell receptor activates Bruton's Tyrosine Kinase (BTK) that then activates PLCy2→PKC→NFAT and NFkB. In this context, BTK recognizes targets through tyrosines on the tyrosine kinase adaptor protein BLNK (FIG. 15).

Inducible chimeric cytokine receptors comprising a BLNK fusion with the tyrosine kinase activating domain substituting for the endogenous BLNK-phosphorylating kinase BTK (e.g. "CD8 SS-Myc-FKBP(F36V)-EpoR(237-338; L241G, L242P)-XYZ Cytotail") were generated (SEQ ID NOS: 39, 40, and 41). In some embodiments, the inducible chimeric cytokine receptor comprises tandem tyrosine effector domains such as a cytokine receptor cytotail and a tyrosine kinase adaptor protein.

Example 7: Effect of Dimerization of Inducible Chimeric Cytokine Receptors on CAR-T Cell Persistence as Compared to GoCART In this study, lentiviral (pLVX) constructs were generated comprising an SFFV promoter followed by a kozak sequence, the inducible chimeric cytokine receptor, a T2A sequence, and a chimeric antigen receptor. The chimeric antigen receptor was directed towards cells expressing EGFRvIII. For comparison, lentiviral constructs with either TagBFP or GoCART instead of the inducible chimeric cytokine receptor were used. GoCART consists of a myristoylation sequence followed by a portion of MyD88 and CD40 fused to two repeats of FKBP(F36V).

CD3+ T cells were isolated from human peripheral blood mononuclear cells and cultured with IL-2. The T cells were transduced with lentivirus 2 days after isolation, and 3 days later were FACS sorted by binding APC-labeled EGFRvIII. The sorted EGFRvIII+ cells were cultured until 14 days post isolation.

At day 14, the 0.5e6 cells were resuspended in a 24-well plate, and grown with either IL2, AP1903, or no treatment for 8 days post production. Live cell count results are summarized in FIG. 16 and FIG. 17.

Figure 16:
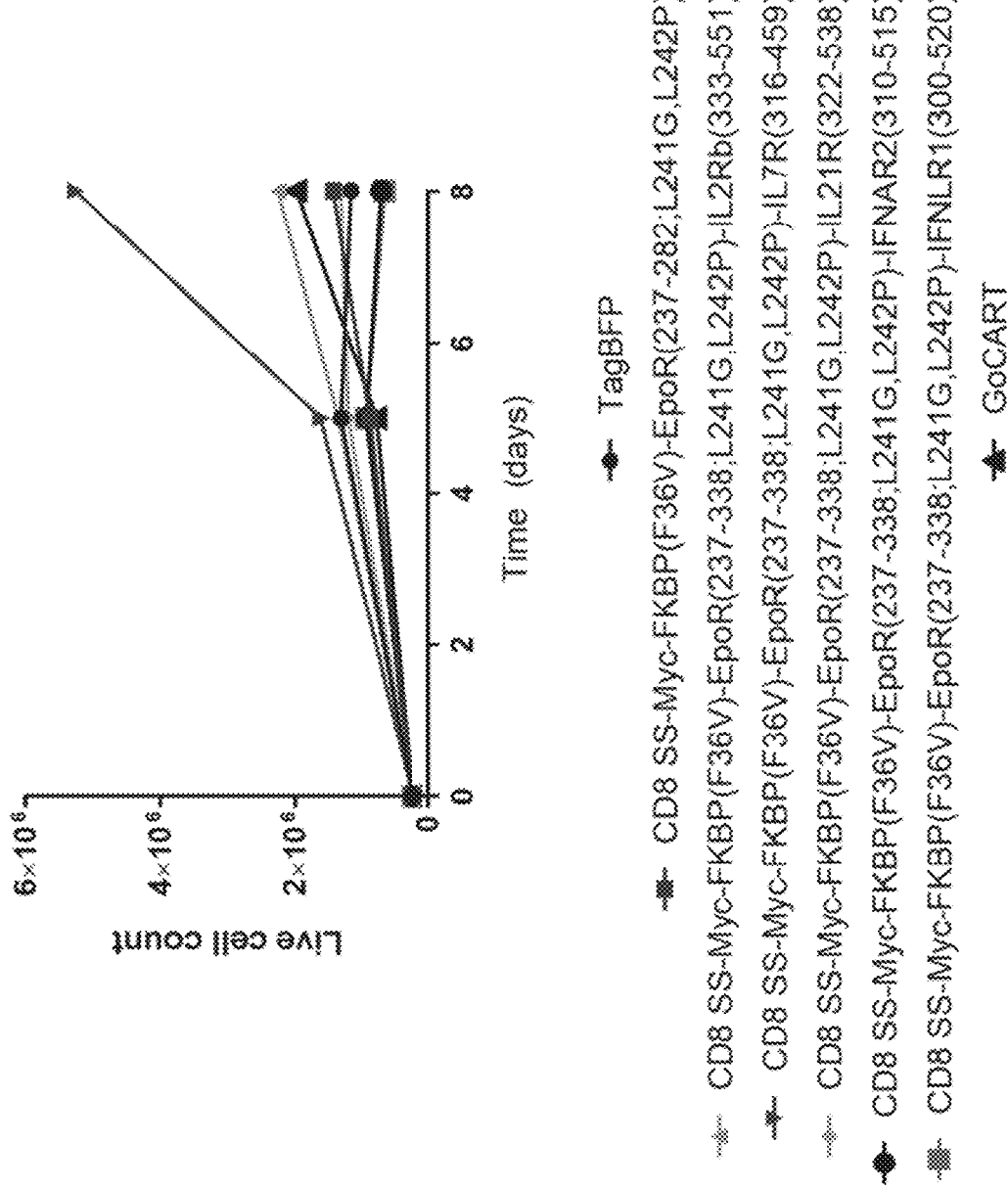
FIG. 16 depicts a graph summarizing the effects of the indicated inducible chimeric cytokine receptors on cell growth.
Figure 17:
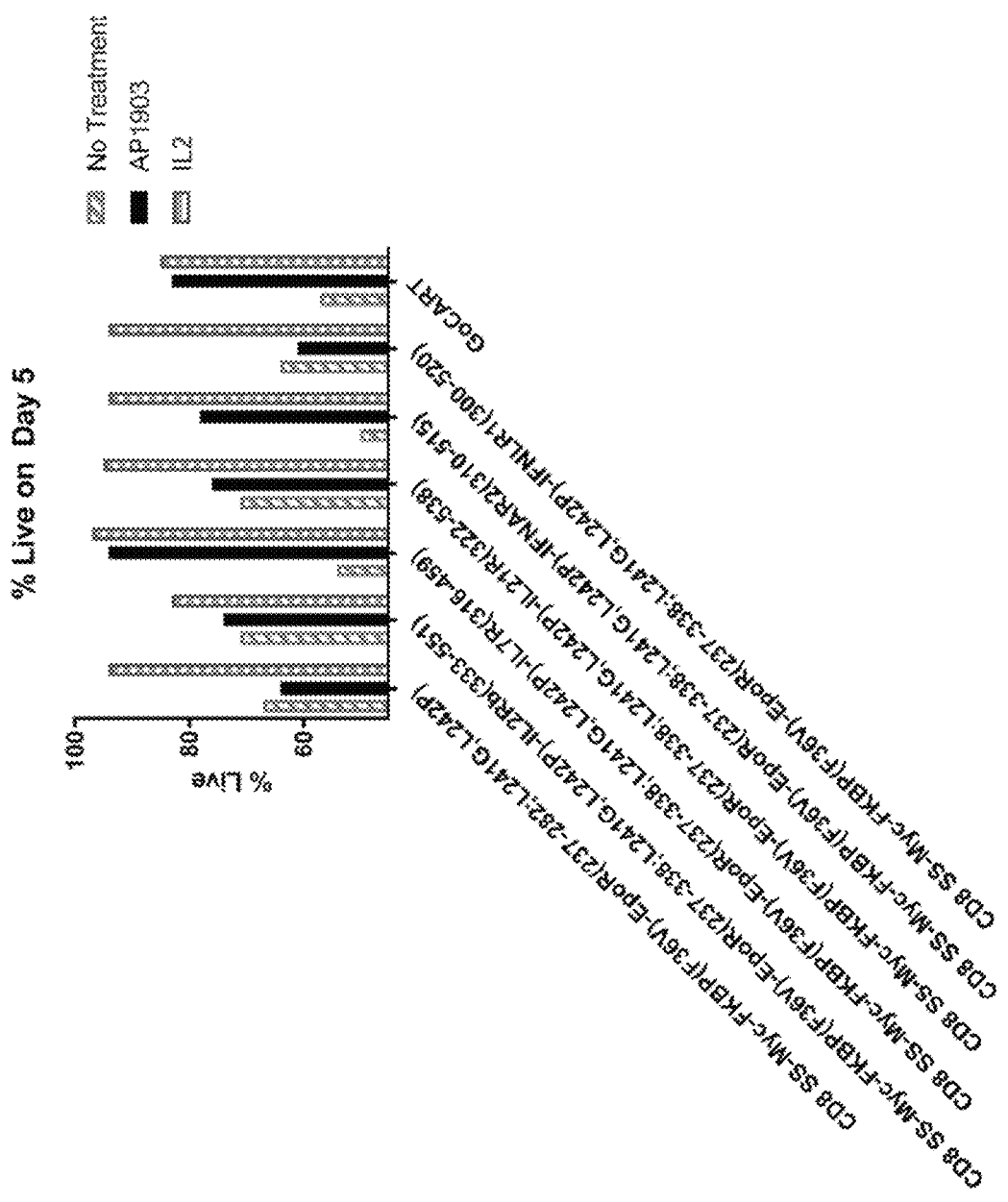
FIG. 17 depicts a graph summarizing the effects of the indicated inducible chimeric cytokine receptors on cell survival.

Several constructs comprising AP1903 inducible receptors promoted slight growth (e.g. CD8 SS-Myc-FKBP (F36V)-EpoR(237-338; L241G, L242P)-IL2Rb(333-551) (SEQ ID NO 5), and GoCART (a previously reported multimerizer, Myristoyl-Myd88-CD40-FKBP(F36V)×2, but only the CD8 SS-Myc-FKBP(F36V)-EpoR(237-338;

L241G, L242P)-IL7R(316-469) (SEQ NO 6) promoted robust growth (FIG. 16). The IL7R(316-469) cytotail containing receptor and GoCART tails maintain a higher viability with AP1903 comparable to IL2 treatment (FIG. 17).

Figure 18:
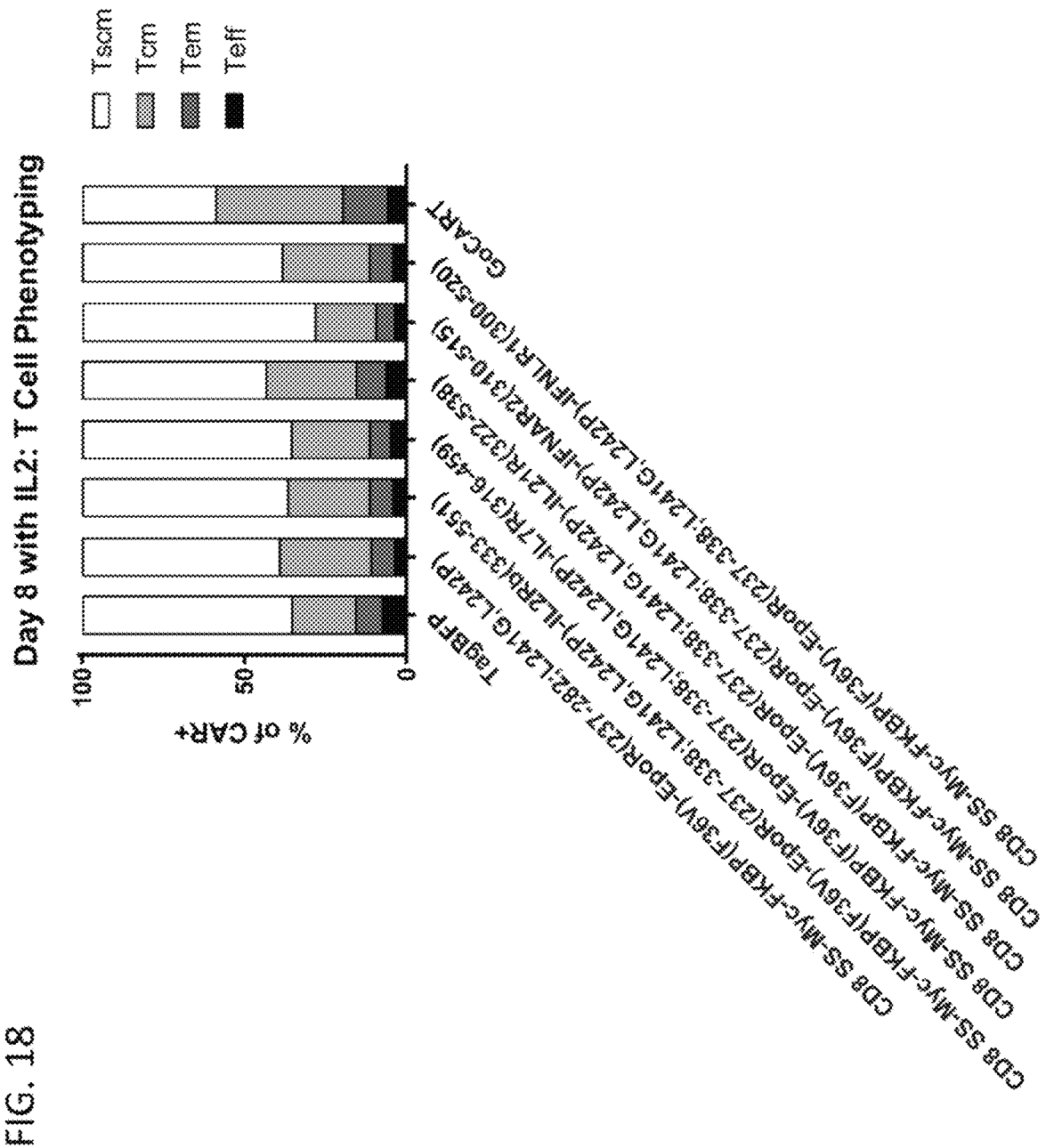
FIG. 18 depicts a graph summarizing the effects of the indicated inducible chimeric cytokine receptors on cell phenotype.
Figure 19:
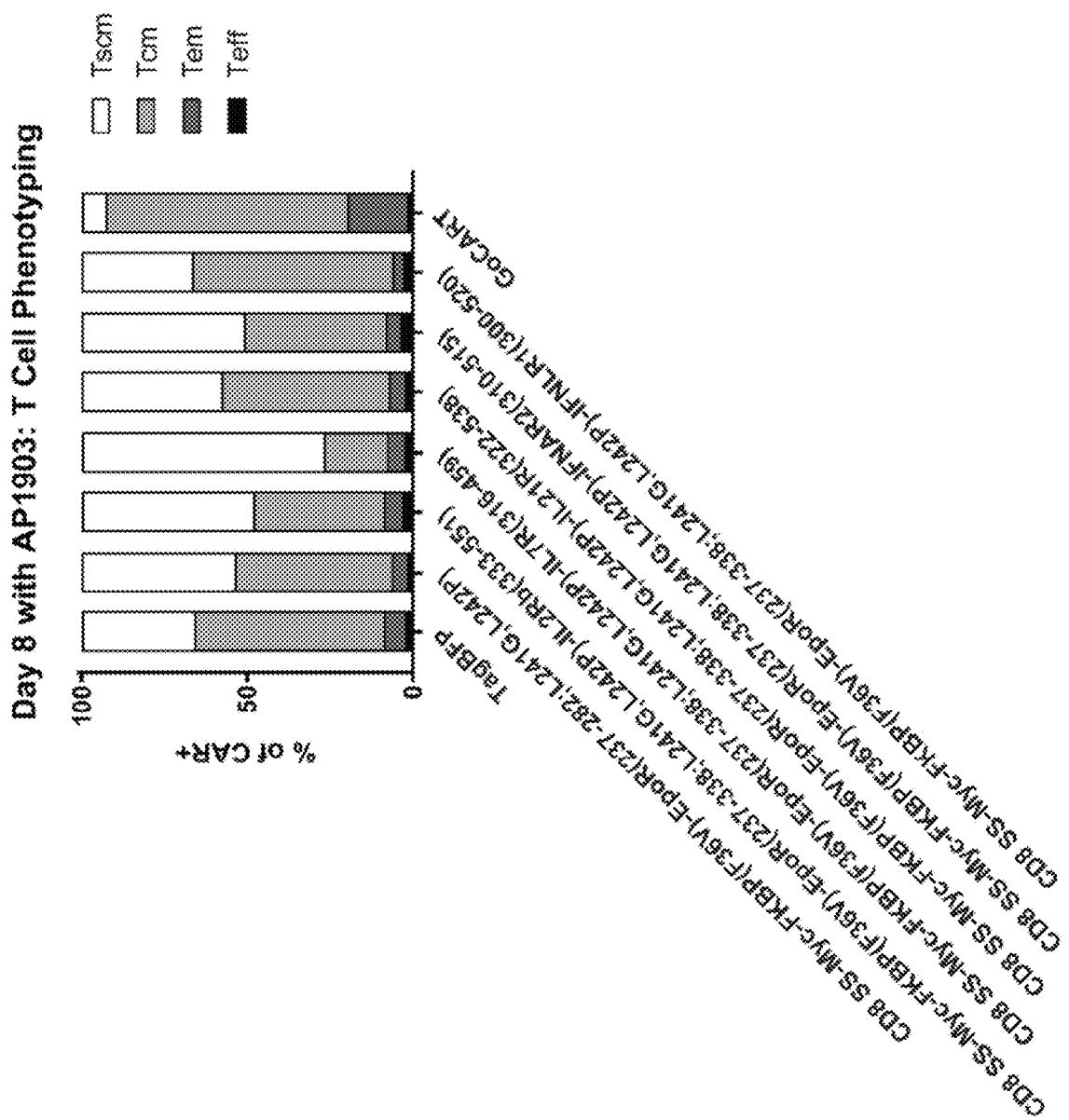
FIG. 19 depicts a graph summarizing the effects of the indicated inducible chimeric cytokine receptors on cell phenotype.

At day 8 post production growth with AP1903 or IL2, cells were phenotyped. Results are summarized in FIG. 18 and FIG. 19. Inducible IL7R(316-469) containing receptor demonstrate more stem cell memory whereas the GoCART demonstrated less stem cell memory and more effector memory. Viability of all cells appeared comparable when grown further with IL2; however, the GoCART appeared somewhat more differentiated. The results demonstrate that the small molecule inducible IL7R(316-469) receptor promotes proliferation while preserving a less differentiated state.

Figure 20:
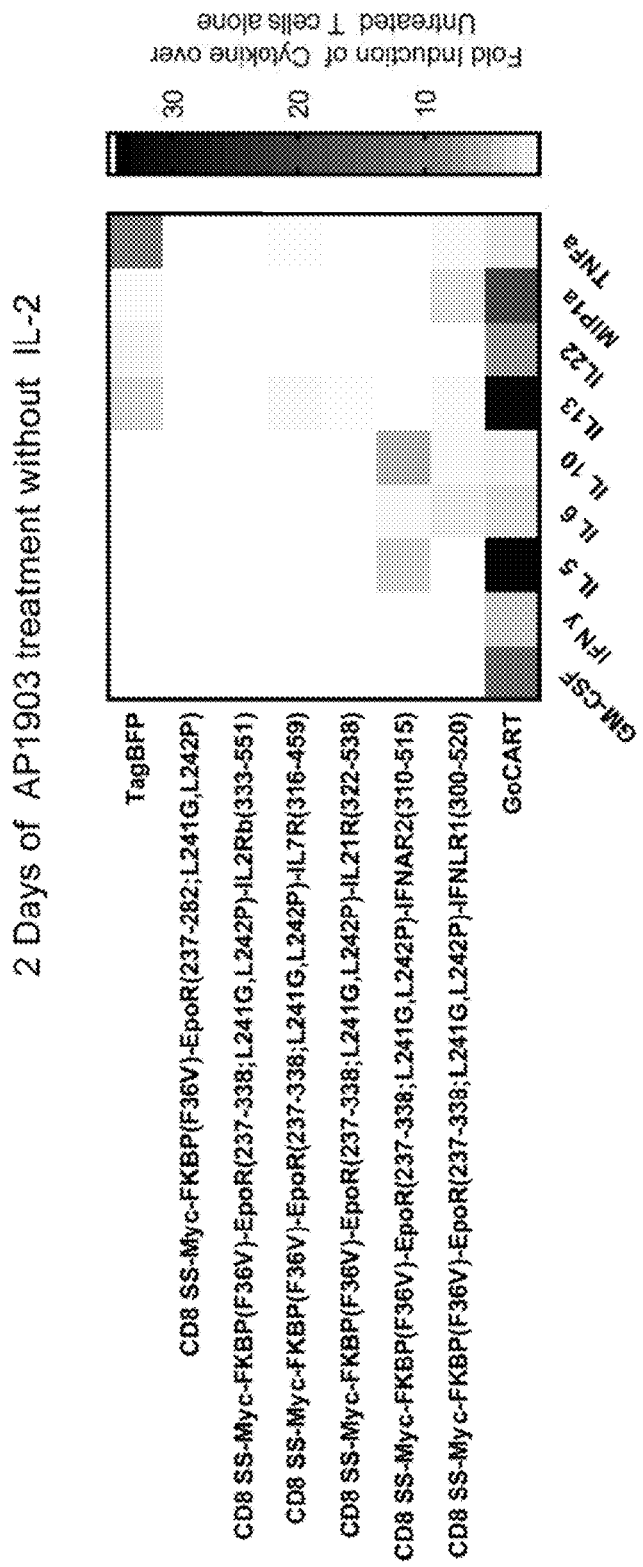
FIG. 20 depicts a graph summarizing the effects of the indicated inducible chimeric cytokine receptors on cytokine release.
Figure 21:
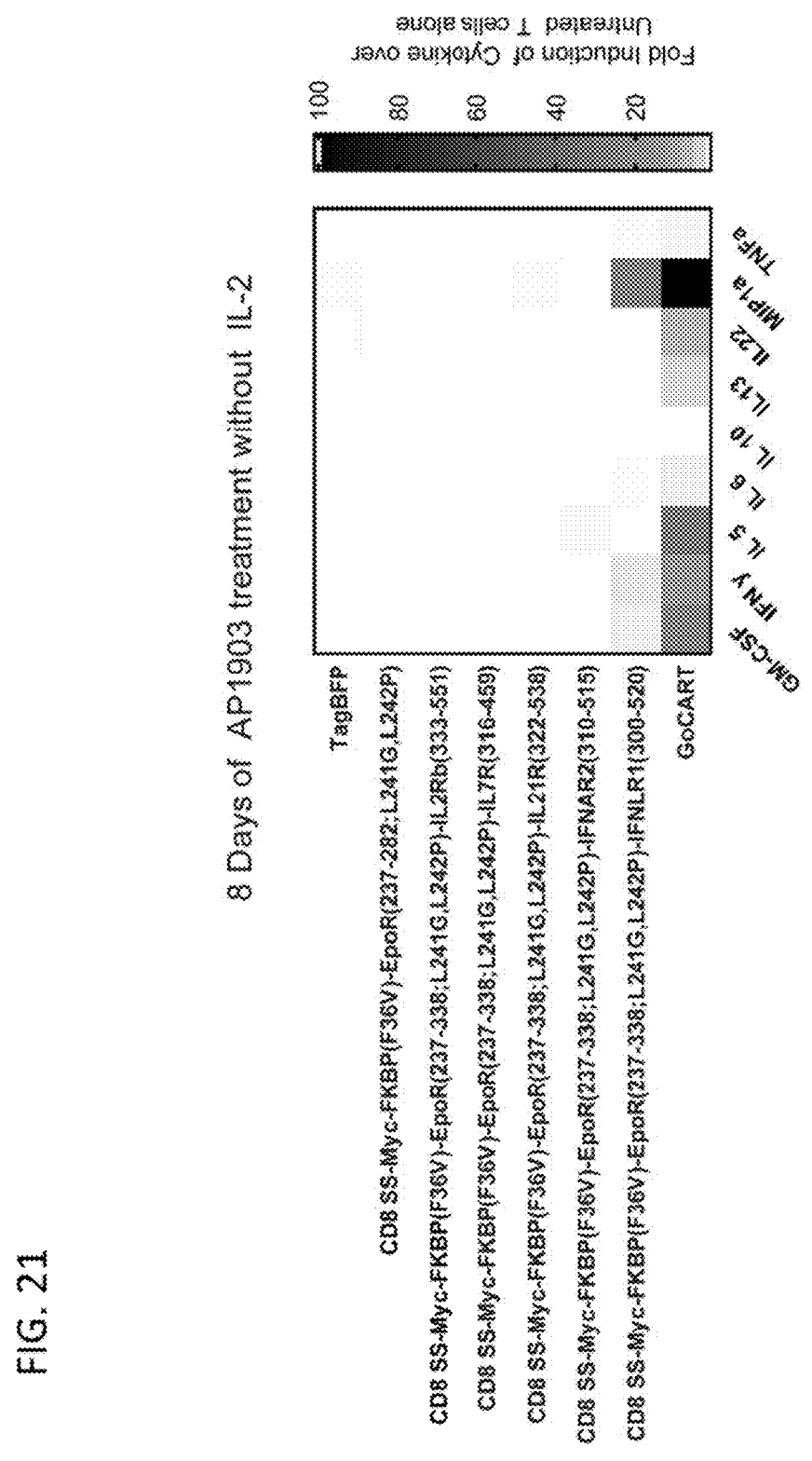

Cytokines were measured on day 2 and day 8. AP1903 data is shown FIG. 20 and FIG. 21. All values were normalized to untreated TagBFP-expressing CAR-T Cells. As GoCART activates the NFkB pathway, this results in robust cytokine release whereas the others do not. The IFN-related tails do incur some cytokine release.

Figure 22:
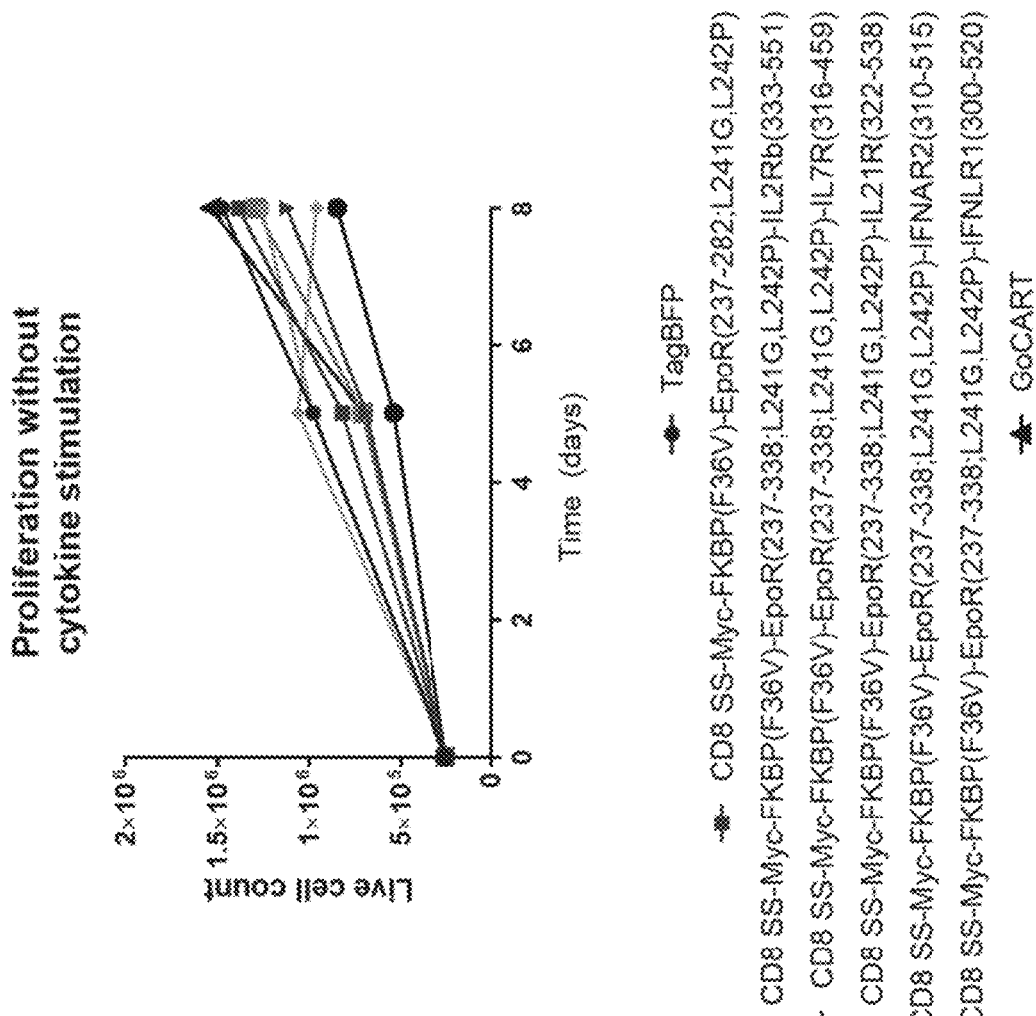
FIG. 22 depicts a graph summarizing the effects of the indicated inducible chimeric cytokine receptors on proliferation in the absence of signaling.

Without signaling, all constructs provide comparable growth (~ a doubling over a week), with some less growth of cells comprising an inducible chimeric cytokine receptors with the IFNAR2 tail (FIG. 22).

Figure 23:
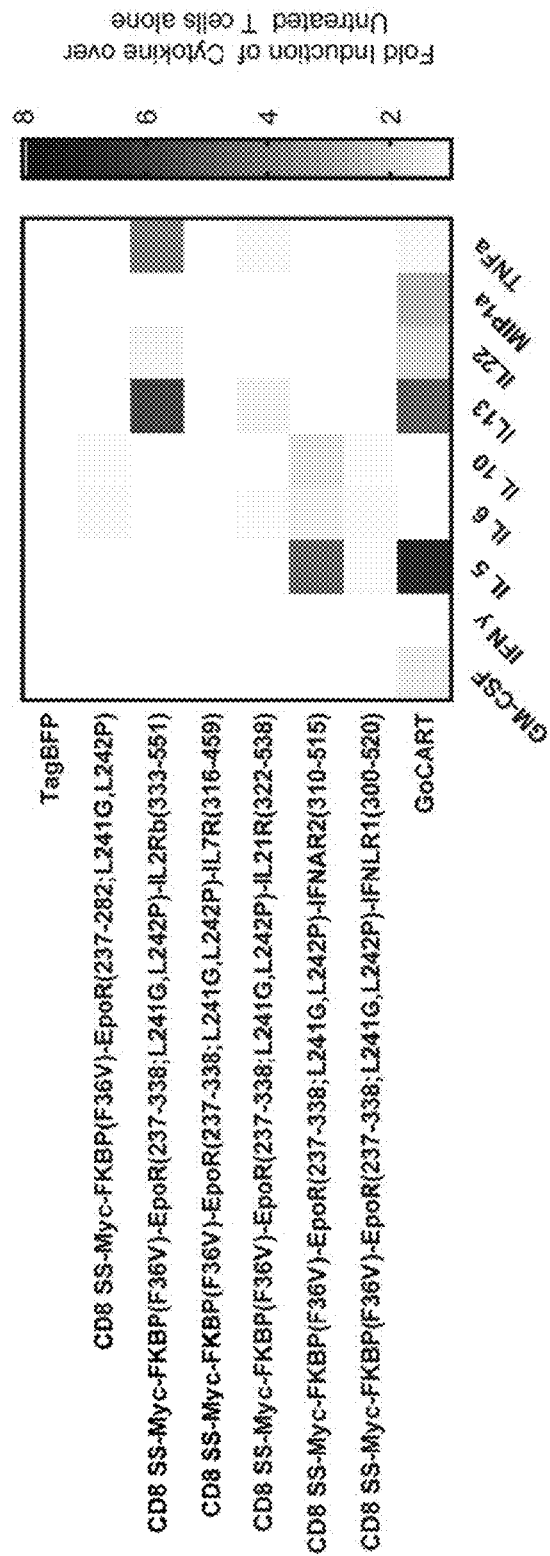
FIG. 23 depicts a graph summarizing the effects of the indicated inducible chimeric cytokine receptors on cytokine release in the absence of signaling.
Figure 24:
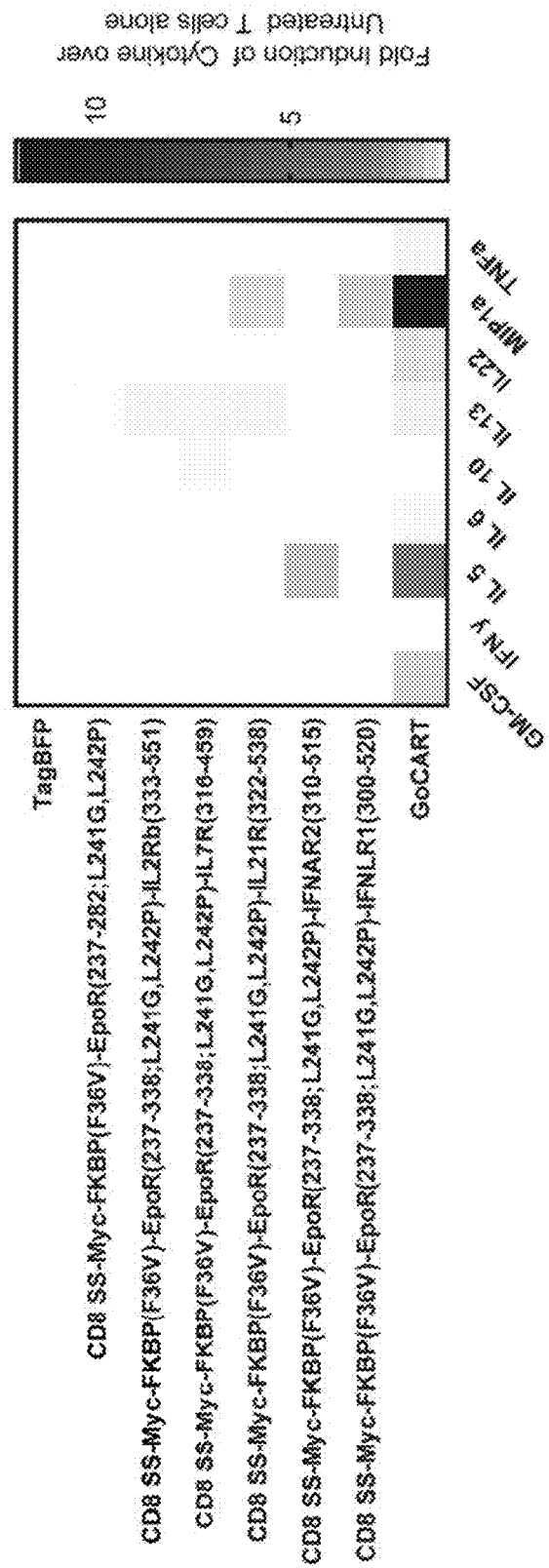
FIG. 24 depicts a graph summarizing the effects of the indicated inducible chimeric cytokine receptors on cytokine release in the absence of signaling.

Induction of cytokines at day 2 and 8 post production without any treatment was measured. Results are summarized in FIG. 23 and FIG. 24. CAR-T cells expressing a small molecule inducible IFNAR2(310-515) construct constitutively release small amounts of IL5 while the CAR-T cells expressing a small molecule inducible IL2Rb(333-551) construct release IL13 and some TNFa (day 2, FIG. 23) that diminishes by day 8 (day 8, FIG. 24). GoCART expressing cells GM-CSF, IL5, IL13, IL22, and MIP1a at day 2 and more so at day 8 time points. The results demonstrate the IFNAR2(310-515) and IL2Rb(333-551) tails are mildly autoactivating while GoCART is strongly so. No cytokine release was observed from the IL7R(316-459) tail construct, and minimal cytokine release was observed for all inducible chimeric cytokine receptor constructs in the absence of small molecule activation.

Figure 25:
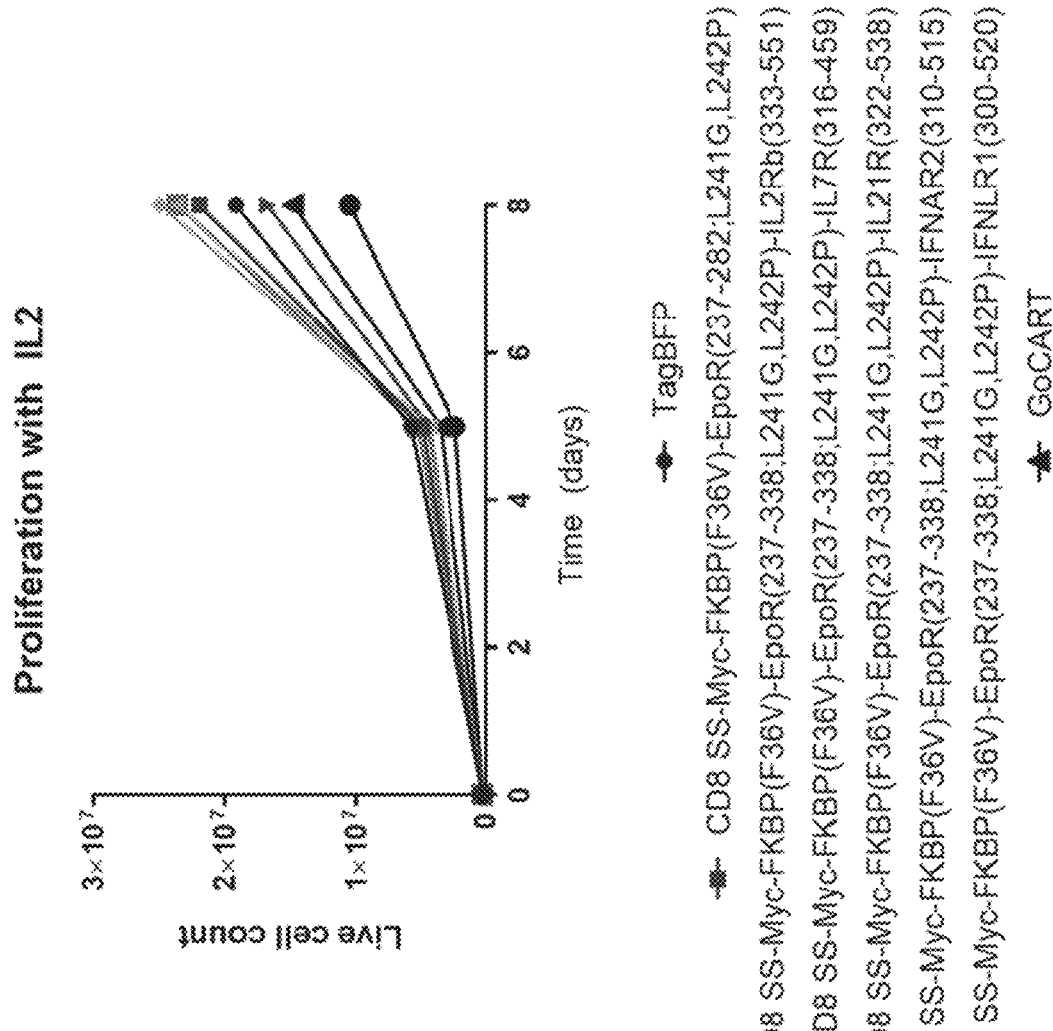
FIG. 25 depicts a graph summarizing the effects of the indicated inducible chimeric cytokine receptors on cell growth.

FIG. 25 shows a graph summarizing CAR-T cell counts on post-production day 5 and day 8 for CAR T cells transduced with inducible chimeric cytokine receptors having different tails, GoCART, a inducible cytokine receptor with no JAK2 binding motif or tyrosine effector domain (CD8 SS-Myc-FKBP(F36V)-EpoR(237-282; L241G, L242P), or TagBFP. The least growth was observed for the IFNAR2 tail; from Day 8 cytokine measurements, it was observed these CAR T cells did not consume as much IL-2.

The AP1903 inducible cytokine receptor provided herein is a robust platform for instigating IFN, IL2, IL7, IL12, IL21, EGFR, and other tyrosine kinase-based signaling in CAR-T cells. EpoR recruits a kinase that is activated upon homodimerization (JAK2) and phosphorylates signaling effectors entirely dependent on the attached cytotail. Depending on the desired function in a CAR-T cell, engineered cytotails (e.g., IL7 cytotail fused with IL12Rb2(775-825) or EGFR cytotail portions) can be utilized to achieve the desired effect. The signal strength of the system can also be tuned using different tyrosine kinase activating domains. For example, the signal strength can be tuned using tyrosine kinase activating domains comprising different transmembrane variants as described herein.

The IL7(316-450) tyrosine effector domain provides STAT5 signaling with minimal PI3K that is sufficient to promote growth without driving differentiation or cytokine release. In addition, the IL7 tail is also less internalized and degraded.

Example 8: Engineering Inducible Cytokine Receptors with Multiple Outputs

A HEK293T cell reporter assay was used to test the inducibility and magnitude of cytokine signaling. Briefly, 20,000 HEK293T cells were plated into each well of a poly-L-lysine-coated 96-well flat-bottom plate and allowed to adhere overnight. An inducible cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with 1 ug/mL AP1903 (Apex Bio) diluted in serum-free media. Fold induction of Stat5 reporter activity was normalized to that of HEK293T cells transfected with all vectors except for the inducible cytokine receptor and that were left untreated.

FIG. 26 shows a schematic example of inducible cytokine receptors with dual IL-7R and IL-21R outputs. As cytokines often have synergistic effects on enhancing T cell responses (e.g. IL-7 with IL-21; IL-2 with IL-21), the ability to mimic multiple cytokine signaling outputs may be beneficial. To generate multiple cytokine signaling outputs, two cytotails were joined in tandem at the intracellular C-terminus of the chimeric receptor.

When generating multiple outputs, the proximity of individual cytotails to the cell membrane can influence the strength of their respective signaling outputs. Table 5 below shows examples of inducible cytokine receptors with the dual outputs, where each output was placed either proximal or distal to the cell membrane.

Figure 27A:
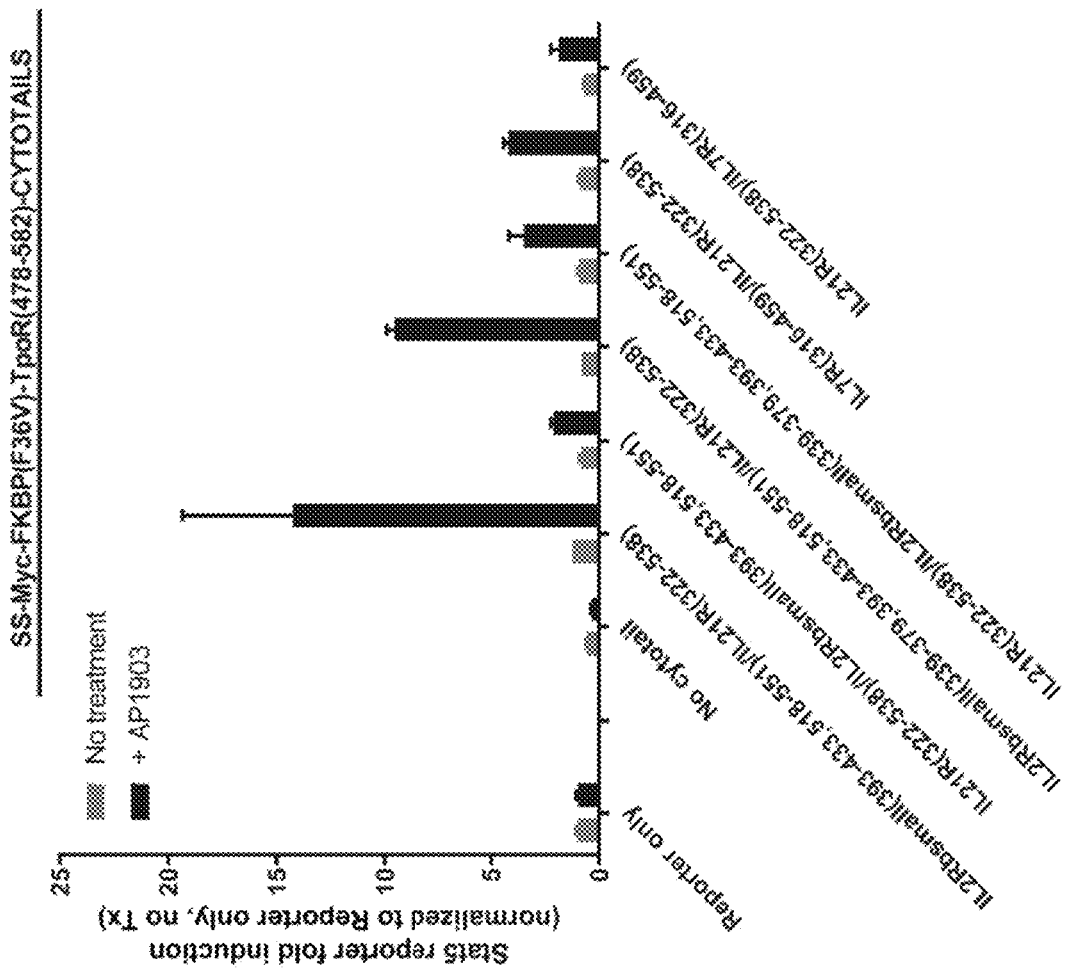
FIG. 27A depicts a graph summarizing results of a cell-based reporter assay testing function of the indicated inducible chimeric cytokine receptors.
Figure 27B:
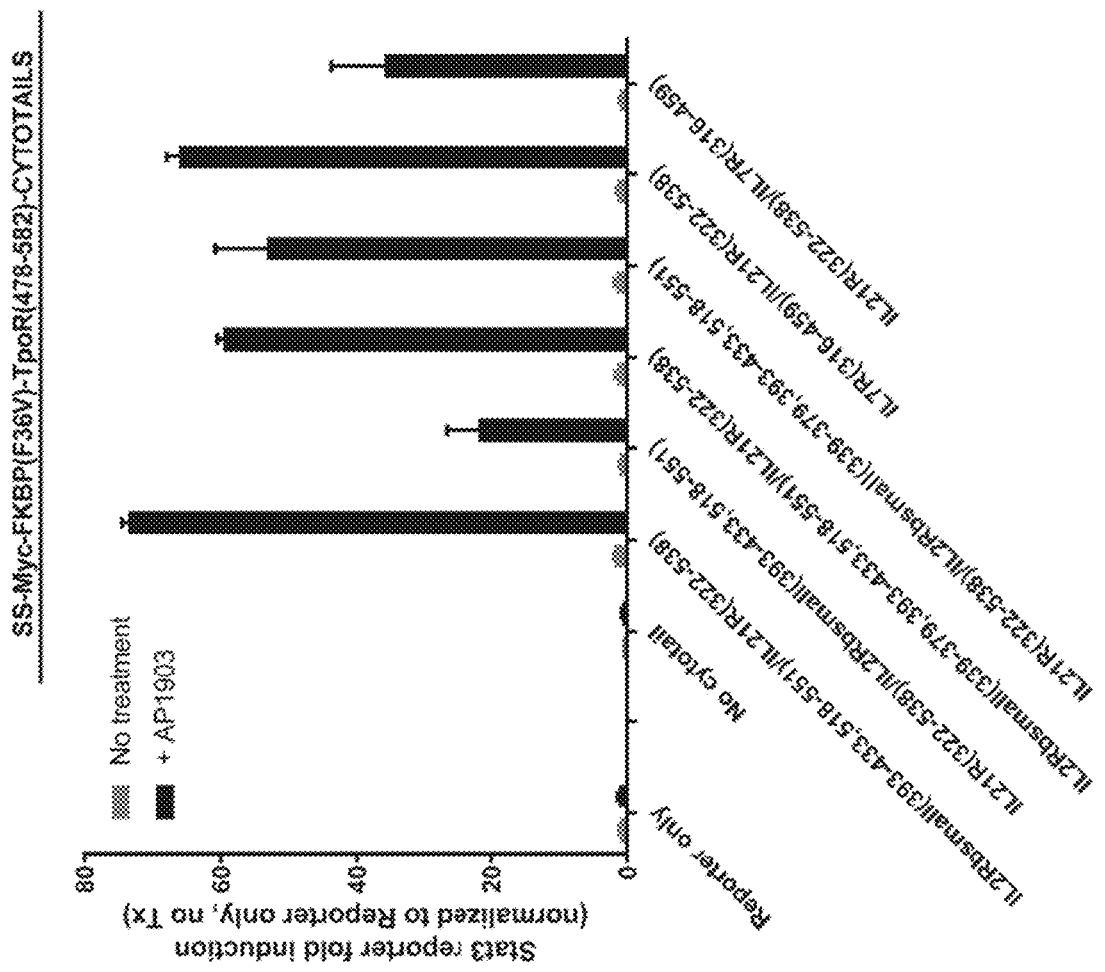
FIG. 27B depicts a graph summarizing results of a cell-based reporter assay testing function of the indicated inducible chimeric cytokine receptors.

FIG. 27 shows a luciferase assay readout for Stat reporter activity in HEK293T cells. The membrane-distal placement of IL-21R cytotail resulted in greater Stat5 (FIG. 27a) and Stat3 (FIG. 27b) reporter activity. Therefore, maximal signaling strengths of different cytotails can additionally be tuned by their relative placements to the cell membrane.

To evaluate these dual output inducible cytokine receptors in the context of primary human CAR T cells, inducible cytokine receptors were cloned into a lentiviral vector encoding the EGFRvIII-specific CAR (2173 scFv; described in Sci Transl Med. 2015 Feb. 18; 7(275): 275ra22.) to allow stoichiometric co-expression. To facilitate the detection of transduced cells, a v5 epitope tag (KPIPNPLLGLDST) was inserted between the scFv and CD8 hinge domain. To make lentivirus encoding FKBP switch CARs, HEK293T cells were plated at 0.45 million cells per mL in 2 mL of DMEM (Gibco) supplemented with 10% FBS (Hyclone) per well of a 6-well plate on Day −1. On Day 0, the lentivirus was prepared by mixing together lentiviral packaging vectors 1.5 ug psPAX2, 0.5 ug pMD2G, and 0.5 ug of the appropriate transfer CAR vector in 250 uL Opti-MEM (Gibco) per well of the 6-well plate ("DNA mix"). 10 uL Lipofectamine 2000 (Invitrogen) in 250 uL Opti-MEM was incubated at room temperature for 5 minutes and then added to the DNA mix. The mixture was incubated at room temperature for 20 minutes and the total volume of 500 uL was slowly added to the sides of the wells containing HEK293T. On Day 0, purified T cells were activated in X-Vivo-15 medium (Lonza) supplemented with 100 IU/mL human IL-2 (Miltenyi Biotec), 10% FBS (Hyclone), and human T TransAct (Miltenyi Biotec, Cat #130-111-160, 1:100 dilution) in a Grex-24 plate (Wilson Wolf, cat #80192M). On Day 1, the media from each well of HEK293T cells in the 6-well plate was replaced with 2 mL per well of T cell transduction media, i.e., X-Vivo-15 supplemented with 10% FBS. On Day 2, T cells were resuspended at 0.5 million cells per mL in 1 mL of T cell transduction media per well of a Grex-24 plate. The lentiviral supernatants from HEK293T cells were harvested and passed through a 0.45 micron filter (EMD Millipore) to remove cell debris, and then added to the T cells along with 100 IU/mL human IL-2. On Day 5, 4.5 mL of T cell expansion media, i.e., X-Vivo-15 supplemented with 5% human AB serum (Gemini Bio) and 100 IU/mL human IL-2 was added to each well of a Grex-24 plate. Cells were expanded into larger G-Rex vessels (Wilson Wolf) as needed using T cell expansion media. On Day 13 or 14, transduction efficiency was determined by detecting the percentage of T cells that bound a FITC-conjugated v5 tag monoclonal antibody (Thermo Fisher) using flow cytometry. On Day 14 or 15, the CAR-T cell products were cryopreserved and thawed as needed for further assays.

To determine the percentage of T cells that were successfully transduced, T cells were first incubated with FITC-conjugated v5 tag monoclonal antibody (Thermo Fisher) in PBS+1% BSA for 20 minutes at 4 C. Then cells were washed with PBS+1% BSA, and analyzed using flow cytometry.

FIG. 28A shows a schematic for the FKBP switch CAR vector containing the cytotails indicated in FIGS. 28B and 28C.

FIG. 28B shows transduction efficiencies of FKBP switch CAR T cells as determined by v5 tag staining.

To determine the inducibility and magnitude of cytokine signaling in FKBP switch CART cells, the thawed CART cell product was serum starved in 100 uL serum-free RPMI (Corning) for 4 hours in humidified incubator at 37° C. with 5% CO2, then treated with 1 ug/ml AP1903 for 1 hour. 40 minutes into AP1903 treatment, an antibody cocktail comprising BUV395-conjugated anti-human CD3 (Biolegend) and FITC-conjugated v5 tag monoclonal antibody (Thermo Fisher) were added to the cells and allowed to incubate for the final 20 minutes. After 1 hour of AP1903 treatment, cells were fixed by the addition of 35 uL of 16% paraformaldehyde was added to each 100 uL sample and allowed to incubate for 15 minutes at 37° C. Cells were then washed three times with PBS, and permeabilized in 100% cold methanol for 1 or 2 nights at −20° C. On the day of FACS analysis, cells were washed three times with PBS, Fc-blocked, and stained with AlexaFluor647-conjugated anti-mouse/human Stat5 (pY694) (BD Biosciences) diluted in PBS+1% BSA. After a 1 hour incubation at room temperature in the dark, cells were washed three times before FACS analysis.

FIG. 28C, bottom-left shows AP1903-induced pStat5 staining by FACS analysis. Consistent with the HEK293T reporter assay, results in primary human CAR T cells revealed that membrane-distal IL-21R cytotail resulted in greater pStat5 induction.

CAR T cells bearing an IL-7R(316-459) cytotail was serum starved in 100 uL serum-free RPMI (Corning) for 4 hours in humidified incubator at 37° C. with 5% CO2, then treated with the indicated working concentrations of AP1903 for 1 hour. 40 minutes into AP1903 treatment, an antibody cocktail comprising BUV395-conjugated anti-human CD3 (Biolegend) and FITC-conjugated v5 tag monoclonal antibody (Thermo Fisher) were added to the cells and allowed to incubate for the final 20 minutes. After 1 hour of AP1903 treatment, cells were fixed by the addition of 35 uL of 16% paraformaldehyde was added to each 100 uL sample and allowed to incubate for 15 minutes at 37° C. Cells were then washed three times with PBS, and permeabilized in 100% cold methanol for 1 or 2 nights at −20° C. On the day of FACS analysis, cells were washed three times with PBS, Fc-blocked, and stained with AlexaFluor647-conjugated anti-mouse/human Stat5 (pY694) (BD Biosciences) diluted in PBS+1 VoBSA. After a 1 hour incubation at room temperature in the dark, cells were washed three times before FACS analysis.

Figure 29:
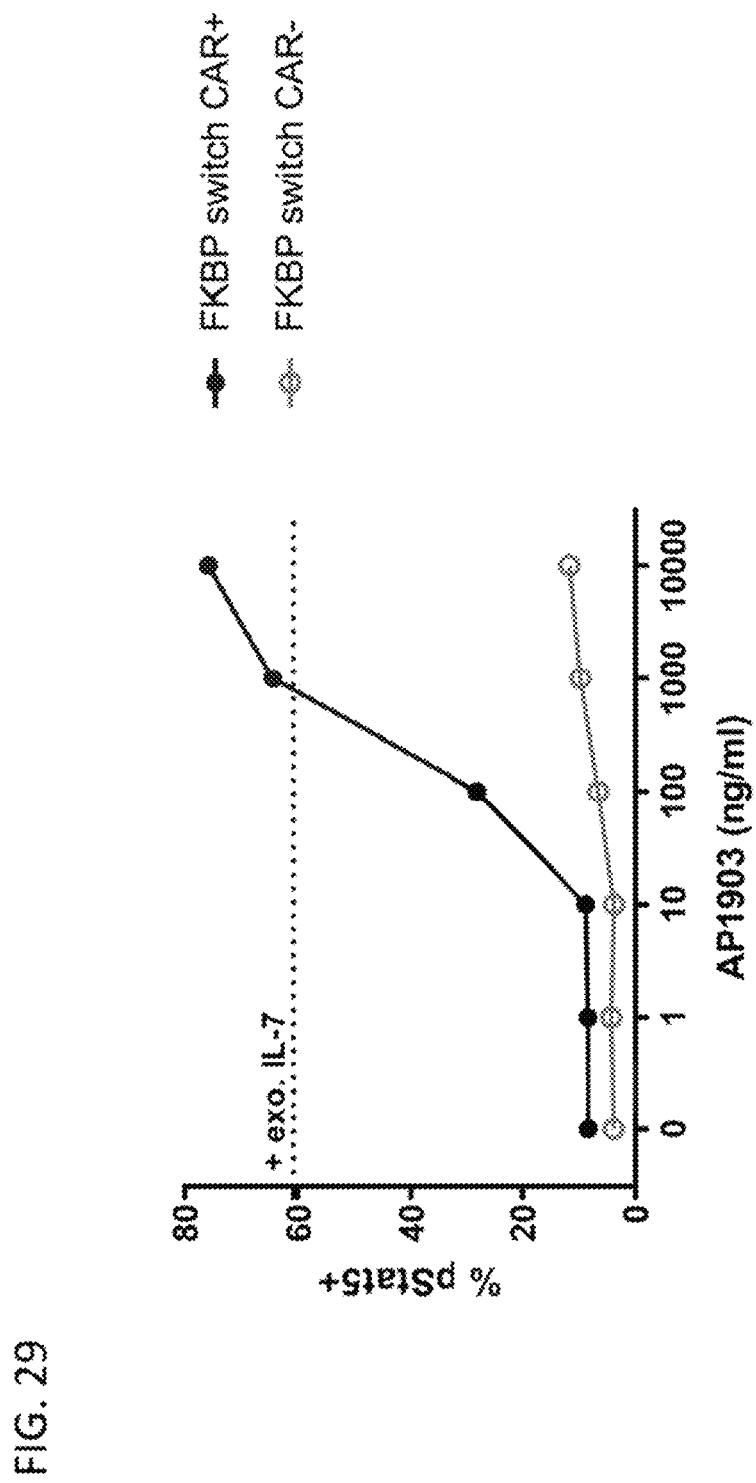
FIG. 29 depicts a graph summarizing results of a FACS analysis testing function of the indicated inducible chimeric cytokine receptors.

FIG. 29 shows Stat5 activation in FKBP switch CAR+ T cells increases with AP1903 in a dose-dependent fashion. In addition, cytokine signaling was FKBP switch CAR+ T cell-specific, as pStat5 was induced specifically in FKBP switch CAR+ T cells—but not CAR− T cells in the same culture. This suggests that the FKBP switch delivers cytokine signals specifically to therapeutic CAR+ T cells, while (i) preventing bystander immune activation that would accelerate allogeneic CAR T cell rejection and (ii) avoiding the toxicities associated with systemic cytokine administration.

Example 10: AP1903-Induced Activation of the FKBP Switch Enhances the Anti-Tumor Activity of CAR T Cells WM266.4 and DMS 273 cells are DLL3+ target cell lines that were purchased from Sigma. To facilitate target cell imaging via the IncuCyte Live Cell Analysis Imaging System, WM266.4 and DMS 273 cells were stably labelled with nuclear GFP by lentiviral transduction with IncuCyte NucLight Green Lentivirus Reagent (Sartorius) to generate WM266.4-nucGFP and DMS 273-nucGFP, respectively. The FKBP switch was cloned into a DLL3 CAR (26C8 scFv) to allow for stoichiometric co-expression.

To test whether FKBP switch CAR T cells showed enhanced target cell lysis and potency following repeated

TABLE 5

Examples of inducible cytokine receptors with dual outputs

| Dual output cytotails | Membrane proximal | Membrane distal |
|---|---|---|
| IL2Rbsmall(393-433, 518-551)/IL21R(322-538) | IL2Rbsmall(393-433, 518-551) | IL21R(322-538) |
| IL21R(322-538)/IL2Rbsmall(393-433, 518-551) | IL21R(322-538) | IL2Rbsmall(393-433, 518-551) |
| IL2Rbsmall(339-379, 393-433, 518-551)/IL21R(322-538) | IL2Rbsmall(339-379, 393-433, 518-551) | IL21R(322-538) |
| IL21R(322-538)/IL2Rbsmall(339-379, 393-433, 518-551) | IL21R(322-538) | IL2Rbsmall(339-379, 393-433, 518-551) |
| IL7R (316-459)/IL21R(322-538) | IL7R (316-459) | IL21R(322-538) |
| IL21R(322-538)/IL7R (316-459) | IL21R(322-538) | IL7R (316-459) |

Example 9: The FKBP Switch Permits Tunable Cytokine Signaling in CAR T Cells

To determine the tunability of cytokine signaling in FKBP switch CAR T cells in response to AP1903, FKBP switch exposure to target cells in the presence of AP1903, we utilized an in vitro serial killing assay in which a low number of CAR-T cells were co-cultured with an excess of targets. These harsh conditions necessitated that single CAR-T cells lysed multiple target cells serially; in turn, CAR-T cells would undergo proliferation and eventually, differentiation and exhaustion. 5,000 WM266.4-nucGFP target cells were seeded and allowed to attach in 96-well plates with black walls and flat clear bottom in 50 uL RPMI containing 10% FBS (Hyclone), non-essential amino acids, sodium pyruvate and 20-25 mM HEPES. DLL3 CAR T cells bearing an FKBP switch, or control CAR T cells were thawed and added to plated target cells at an Effector:Target (E:T) ratio of 1:9.

FIG. 30A shows the schematic of the a DLL3 CAR bearing an FKBP switch with dual outputs (IL7Ra(316-459)/IL12Rb2(775-825) cytotails) that was used.

FIG. 30B and FIG. 30C show in vitro cytotoxicity of DLL3 CAR T cells against DLL3+ target cells. While control CAR T cells lacking the FKBP switch failed to effectively lyse target cells at this low, sub-optimal E:T ratio (FIG. 30B), AP1903-induced activation of the FKBP switch dramatically enhanced CAR T cell cytotoxicity (FIG. 30C). Therefore, AP1903 enhances the potency of FKBP switch CART cells.

A challenge in CAR T cell therapy is the low expression levels of tumor targets, which results in sub-optimal CAR activation and cytotoxicity. To test whether FKBP switch activation enhanced CAR T cells' sensitivity to low target-expressing cells, we utilized the DMS 273-nucGFP target cell line that has a low DLL3 surface expression (400 DLL3/cell). 5,000 DMS 273-nucGFP target cells were seeded and allowed to attach in 96-well plates with black walls and flat clear bottom in 50 uL RPMI containing 10% FBS (Hyclone), non-essential amino acids, sodium pyruvate and 20-25 mM HEPES. DLL3 CAR T cells bearing an FKBP switch, or control CAR T cells were thawed and added to plated target cells at an Effector:Target (E:T) ratio of 1:1.

FIG. 30D and FIG. 30E show in vitro cytotoxicity of DLL3 CAR T cells against target cells expressing low levels of DLL3. FIG. 30D show that control CAR T cells were ineffective even at a higher E:T ratio of 1:1. In contrast, FIG. 30E shows that FKBP switch activation enhanced the cytotoxicity of CAR T cells and increased their sensitivity towards low target-expressing cells.

We next interrogated the activity of FKBP switch CAR T cells in vivo using a human tumor xenograft model. LN229-EGFRvIII was derived from the human glioblastoma cell line, LN229 (ATCC), by stable transduction with full-length human EGFRvIII. 3 million LN229-EGFRvIII cells in 200 uL serum-free RPMI were implanted subcutaneously into NSG mice. Tumor growth was monitored by caliper measurements using a digital caliper starting from Day 21 post-implantation. Tumor size was calculated using the formula Tumor volume=(width^2×length/2). Mice were randomized into groups of 8 based on tumor volume on Day 24 post-implantation, and the average tumor volume per group was 200 mm3. On Day 25 post-implantation, Non-transduced T cells (NTD), control CAR T cells and FKBP switch CAR-T cells bearing IL7Ra(316-459)/IL12Rb2(775-825) cytotails were thawed and counted according to standard procedure. Cells were resuspended in serum-free RPMI and 3 million CAR+ cells/mouse were injected intravenously in a volume of 100 uL/mouse. The day after T cell infusion, and weekly thereafter, each group also received intraperitoneal infusions of either 5 mg/kg AP1903 or vehicle control (n=8 per group). Tumors were then monitored every 3-4 days until the end of the study.

Figure 31A:
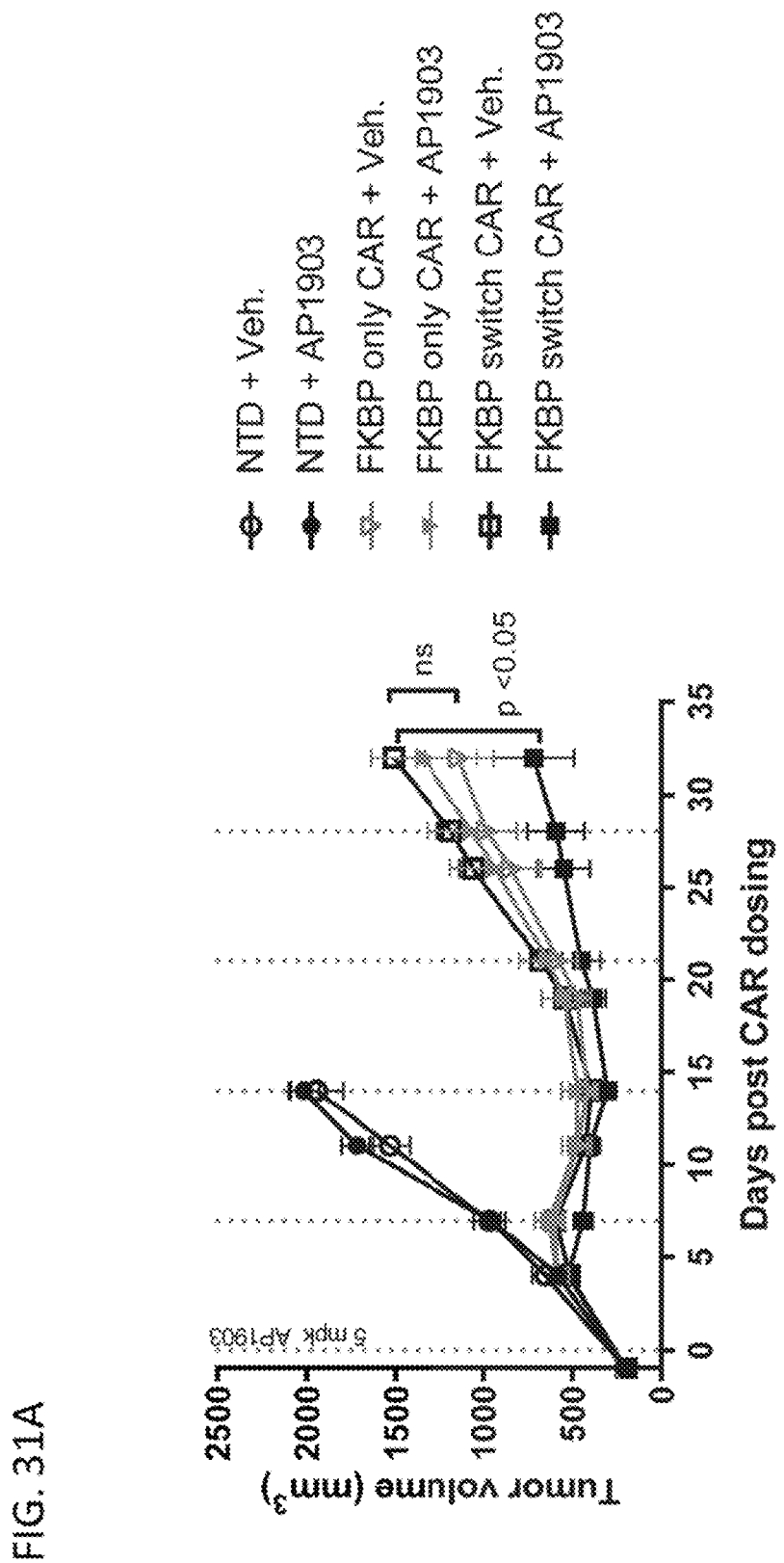
FIG. 31A depicts a graph summarizing results of a tumor volume assay for the indicated treatment groups.
Figure 31G:
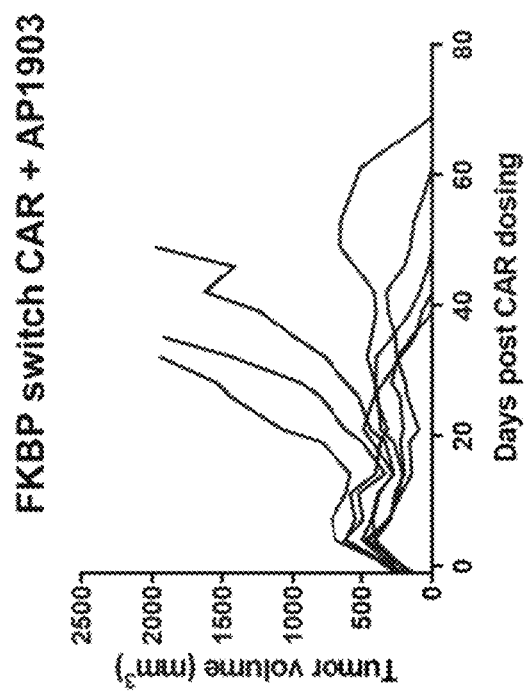
FIG. 31G depicts a graph summarizing results of a tumor volume assay for the indicated treatment group.
Figure 31F:
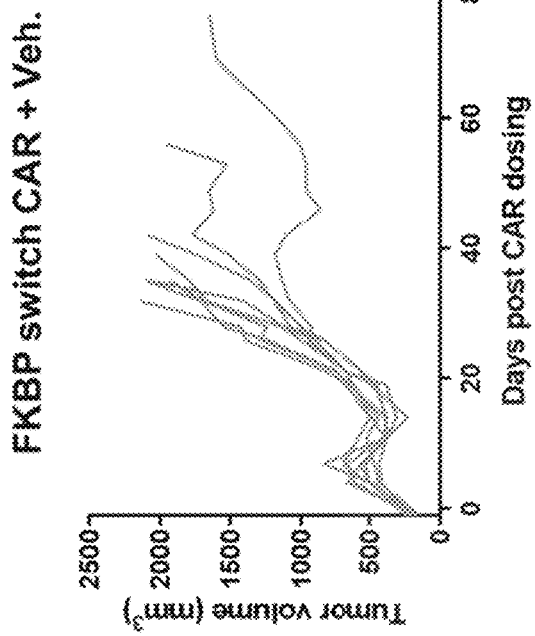
FIG. 31F depicts a graph summarizing results of a tumor volume assay for the indicated treatment group.
Figure 31H:
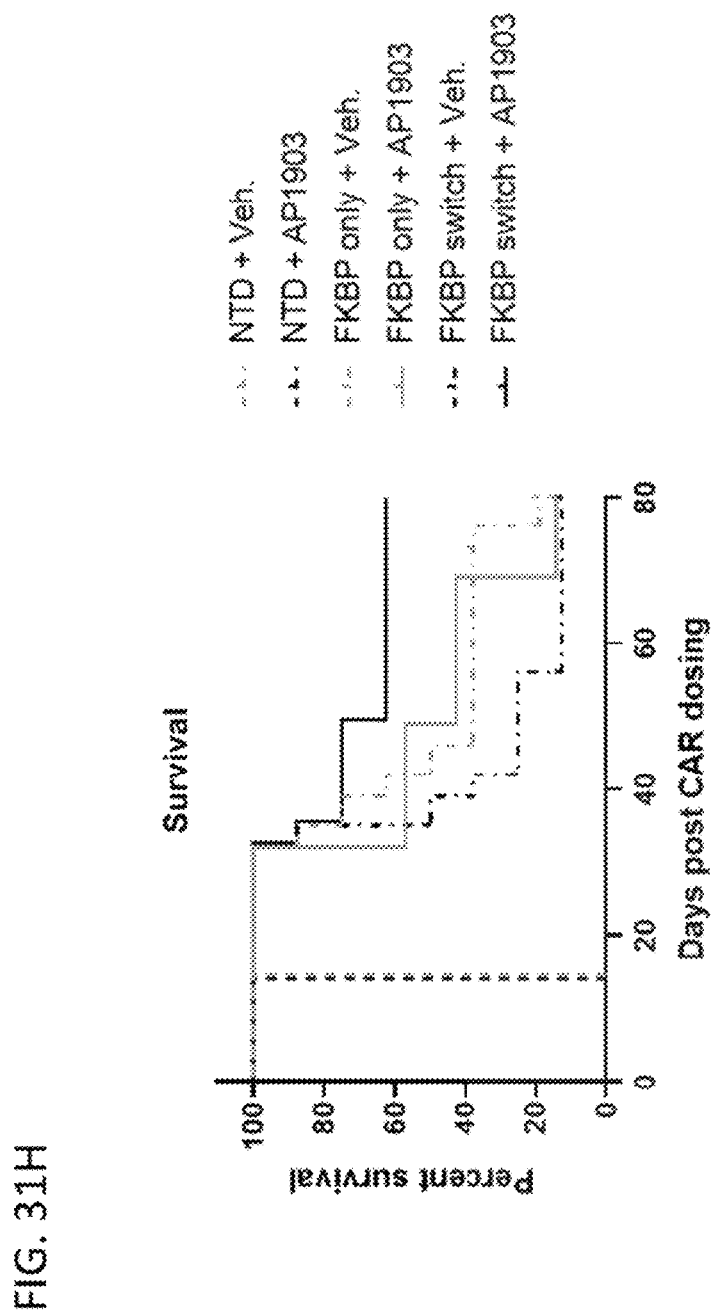
FIG. 31H depicts a graph summarizing overall survival for the indicated treatment groups.

FIGS. 31A-31H show the tumor progression and overall survival in each group of treated mice. As compared to control CAR T cells and to FKBP switch CAR T cells coadministered with vehicle control, the activation of the FKBP switch by AP1903 resulted in significantly enhanced tumor control (FIG. 31A), allowed for a more durable and complete anti-tumor response (FIGS. 31B-31G) and prolonged overall survival (FIG. 31H).

Example 11: AP1903-Induced Activation of the FKBP Switch Enhances the Expansion and Engraftment of CAR T Cells Clinical trials revealed that patient response to CD19 CART cell therapy correlates with high serum levels of homeostatic cytokines (e.g. IL-15) that were critical for driving an initial burst of CAR T cell expansion and engraftment (J Clin Oncol. 2017 Jun. 1; 35(16):1803-1813.). Moreover, unlike in hematological malignancies where target cells in the circulation are readily accessible to CAR T cells, the treatment of solid tumors would likely require CAR T cells to spend a longer time in circulation before extravasating and infiltrating the solid tumor; therefore, target-independent, cytokine-supported CAR T cell expansion and survival would be especially crucial. We thus investigated whether AP1903 alone was sufficient to drive target-independent CAR T cell expansion and persistence.

Control CAR T cells or FKBP switch CAR T cells bearing IL7R(316-459)/IL12Rb2(775-825) cytotails were cultured with the indicated concentrations of AP1903, and in the absence of exogenous cytokines (unless specified in the case of positive controls) or target cells for 2 weeks. As a positive control, CAR T cells were alternatively supplemented with exogenous recombinant IL-7 (10 ng/mL; Miltenyi) and IL-12p70 (10 ng/mL; Biolegend) to mimic the dual IL-7R/IL12Rb2 outputs transmitted by FKBP switch activation. At the end of the 2-week culture, the number and quality of surviving CAR T cells were determined. Briefly, duplicate samples from each culture condition cells were harvested and stained using the Zombie NIR Fixable Viability Kit (Biolegend). Samples were washed with PBS, Fc blocked, then stained with the following antibody cocktail diluted in PBS+1% BSA: BUV395-conjugated anti-human CD3, BV510-conjugated anti-human CD8, BV605-conjugated human CD4 and FITC-conjugated v5 tag (for CAR detection), PE/Cy7-conjugated anti-human CD62L (Biolegend) and BV785-conjugated anti-human CD45RO (Biolegend). Finally, samples were washed in PBS and cell pellets were resuspended in 130 uL PBS+1% BSA containing 123count eBeads counting beads (Thermo Fisher) (10 uL counting beads in 120 uL PBS+1% BSA) prior to FACS analysis.

Figure 32B:
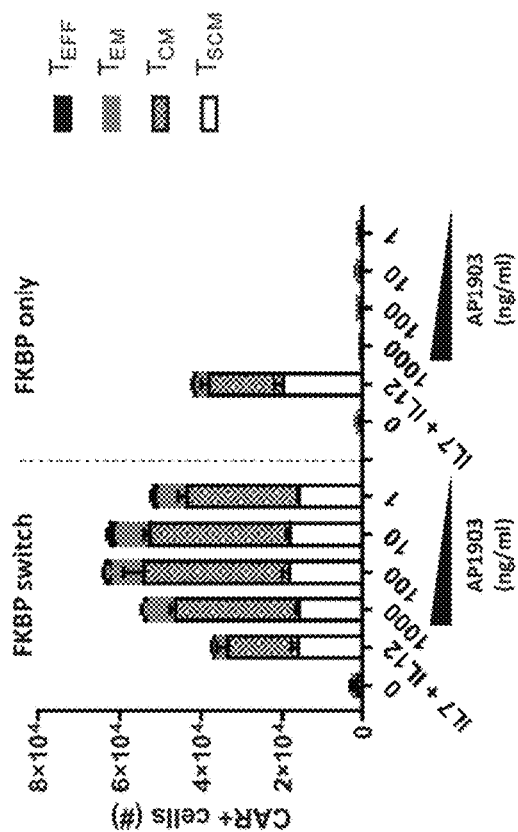
FIG. 32B depicts a graph summarizing the effects of the indicated inducible chimeric cytokine receptors on cell phenotype.
Figure 32A:
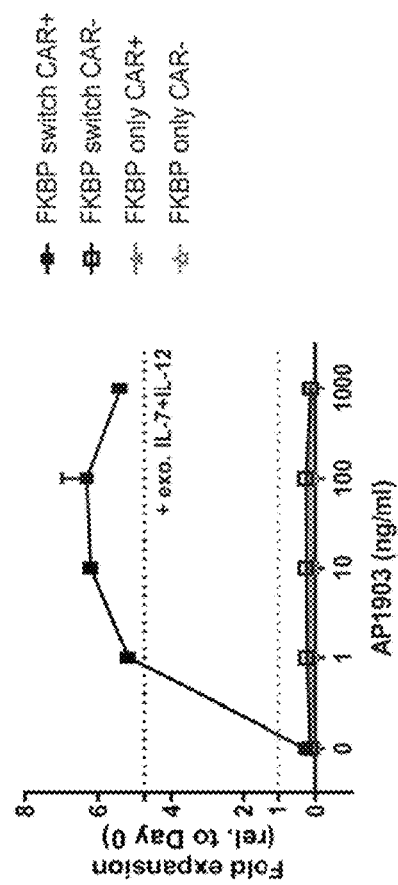
FIG. 32A depicts a graph summarizing expansion of the indicated CAR-T cells.

FIG. 32A shows AP1903-driven expansion of CAR T cells; the dotted line indicates fold expansion of CAR T cells supplemented with exogenous IL7 and IL12p70. In contrast to control CAR T cells lacking the FKBP switch that declined, FKBP switch CAR T cells treated with AP1903 efficiently expanded. Notably, as low as 1 ng/ml AP1903 was sufficient to reach the level of expansion achieved by exogenous cytokine supplementation.

FIG. 32B shows the absolute number and memory T cell phenotypes of the surviving CAR T cells at the end of the 2-week culture. In addition to increasing the quantity of CAR T cells, FKBP switch activation also improved the quality of CAR T cells, as evident by the maintenance and expansion of the stem cell memory (Tscm) and central memory (Tcm) CAR+ T cells, which are the long-lived, self-renewing populations that mediate long-lasting anti-tumor protection.

Figure 9:
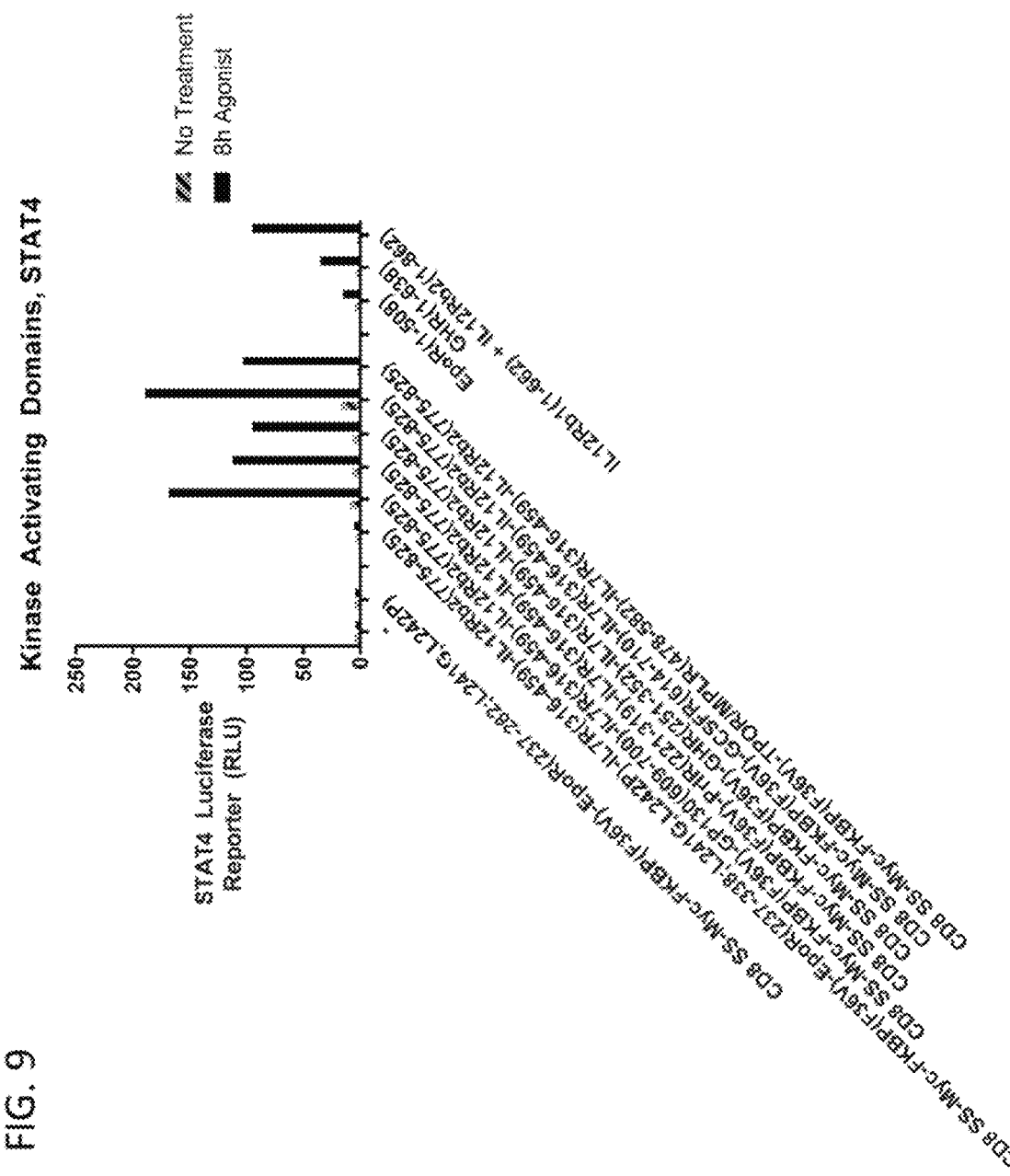
FIG. 9 depicts a graph summarizing results of a cell-based reporter assay testing function of the indicated inducible chimeric cytokine receptors.

Example 12: Engineering Inducible Cytokine Receptors with Reduced Basal Signaling In the presence of ligand, homodimeric cytokine/growth factor receptors (e.g. EpoR and TpoR) in their natural forms rely on two requirements for JAK2 activation: (i) receptor homodimerization and (ii) receptor rotation mediated by the transmembrane region that brings the two JAK2's in close enough proximity for trans-phosphorylation and activation. It has been shown that abrogating receptor rotation by mutating key amino acid residues in the transmembrane region abrogates receptor signaling, even in the presence of ligand. A truly inducible receptor necessitates a clean OFF (no basal activity) in the absence of inducer, and a wide dynamic range of ligand-induced ON for maximal tunability. The tyrosine activation domains from homodimeric cytokine/growth factor receptors demonstrated varying degrees of basal signaling (FIG. 9). EpoR and TpoR have been shown to exist in an equilibrium between monomeric and homodimeric forms in the absence of ligand, and this spontaneous homodimerization was found to be mediated by their transmembrane domains; therefore, we hypothesized that the leakiness observed in our untreated chimeric cytokine receptors was due to their spontaneous ligand-independent homodimerization mediated by their transmembrane domains.

To reduce basal signaling in our chimeric cytokine receptors, we replaced the transmembrane region of EpoR/TpoR with that of PD-1, which exists naturally as a monomer. A HEK293T cell reporter assay was used to evaluate basal signaling in the absence of AP1903, as well as inducibility and magnitude of cytokine signaling in the presence of AP1903. Briefly, 20,000 HEK293T cells were plated into each well of a poly-L-lysine-coated 96-well flat-bottom plate and allowed to adhere overnight. An inducible cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated to assess AP1903-independent basal signaling, or treated with the indicated concentrations of AP1903 (Apex Bio) diluted in serum-free media. Fold induction of Stat5 reporter activity was normalized to that of HEK293T cells transfected with all vectors except for the inducible cytokine receptor and that were left untreated.

Figure 33B:
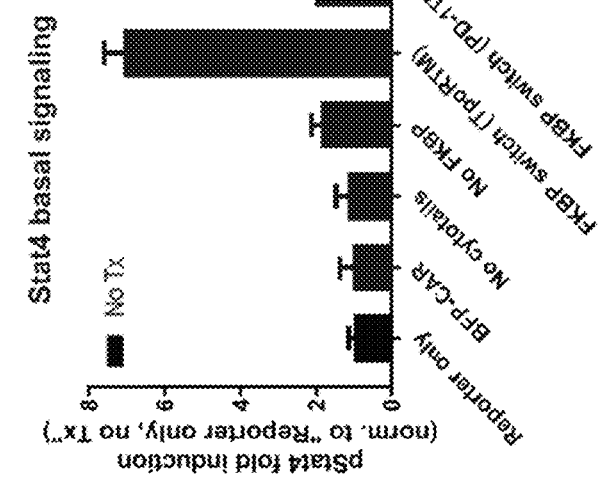
FIG. 33B depicts a graph summarizing results of a cell-based reporter assay testing function of the indicated inducible chimeric cytokine receptors.
Figure 33A:
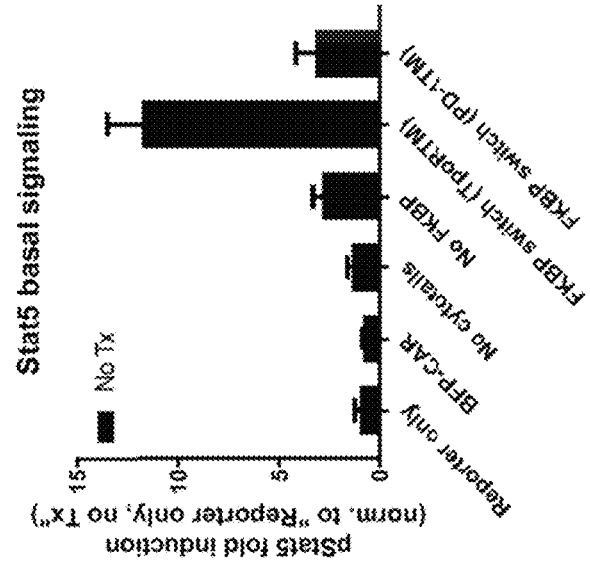
FIG. 33A depicts a graph summarizing results of a cell-based reporter assay testing function of the indicated inducible chimeric cytokine receptors.

FIG. 33A and FIG. 33B show basal signaling in the absence of AP1903 by each chimeric receptor, as determined by Stat5 and Stat4 reporter activity, respectively. Compared to the chimeric receptors bearing the TpoR transmembrane region that showed significant basal Stat activity in the absence of AP1903, substitution with the PD-1 transmembrane region abrogated basal Stat activity to levels comparable to a construct containing only the FKBP ectodomain and lacking any JAK-activating domains and cytotails. In some embodiments, basal signaling of an inducible chimeric cytokine receptor can be further optimized using insertion and/or deletion mutations of transmembrane domains as exemplified in FIG. 38C.

FIG. 33C and FIG. 33D shows the response of each chimeric receptor to the indicated concentrations of AP1903, as determined by Stat5 and Stat4 reporter activity, respectively. Compared to their counterparts with the TpoR transmembrane domain, the FKBP switch variant bearing the PD1 transmembrane region responded comparably in magnitude to AP1903 treatment. Although the transmembrane domain is also believed to be critical for rotational activation of the receptor, substituting the TpoR transmembrane region for that of PD-1 preserved AP1903-induced Stat activation. Taken together, we demonstrate that the PD-1 transmembrane region can be used in combination with tyrosine activation domains from homodimeric cytokine/growth factor receptors to reduce basal signaling while preserving ligand-induced receptor activation.

To test whether substitution with the PD1 transmembrane region preserved the cytotoxic activity of the chimeric receptor, we compared the cytotoxic activity and AP1903-driven expansion of CAR T cells coexpressing either receptor variant. For the in vitro cytotoxicity assay, 5,000 U87KO-EGFRvIII-nucGFP target cells were seeded and allowed to attach in 96-well plates with black walls and flat clear bottom in 50 uL RPMI containing 10% FBS (Hyclone), non-essential amino acids, sodium pyruvate and 20-25 mM HEPES. U87KO-EGFRvIII is a kind gift from Cellectis SA (Paris, France). U87KO-EGFRvIII was derived from the parental cell line, U87MG (ATCC), by first knocking out endogenous wildtype EGFR using Transcription Activator-Like Effector Nucleases (TALEN), and then stably overexpressing full-length human EGFRvIII via lentiviral transduction. To facilitate target cell imaging via the IncuCyte Live Cell Analysis Imaging System, U87KO-EGFRvIII-nucGFP target cells were derived from U87KO-EGFRvIII by a second lentiviral transduction with IncuCyte NucLight Green Lentivirus Reagent (Sartorius). EGFRvIII CAR (2173 scFv) T cells bearing an FKBP switch with either the TpoR or PD1 TM were thawed and added to plated target cells at an Effector:Target (E:T) ratio of 1:4. AP1903 at the indicated concentrations was added to each well. Duplicate wells were set up for each condition FIG. 34A shows the schematic of FKBP switch CARs bearing IL7R(316-459)/IL12Rb2(775-825) cytotails with either the TpoR TM domain or the PD1 TM domain; CAR T cells coexpressing the FKBP ectodomain (FKBP only control CAR) and without any JAK-activating domain and cytotails were used as a control.

Figure 34B:
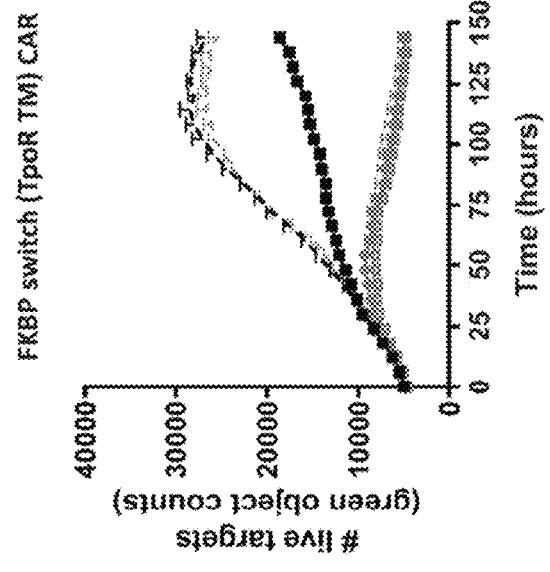
FIG. 34B depicts a graph summarizing results of an in vitro assay testing cytotoxicity of the indicated CAR-T cells.
Figure 34C:
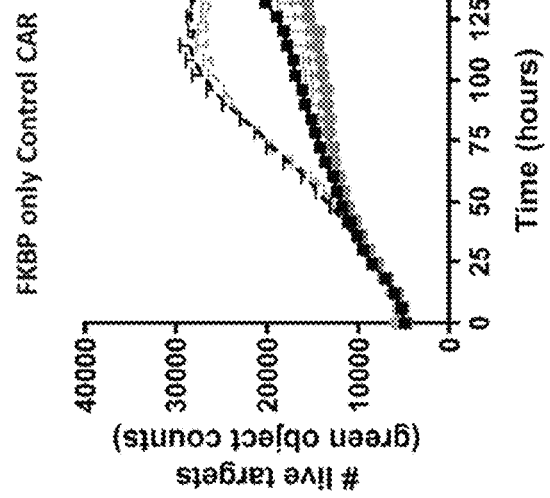
FIG. 34C depicts a graph summarizing results of an in vitro assay testing cytotoxicity of the indicated CAR-T cells.
Figure 34D:
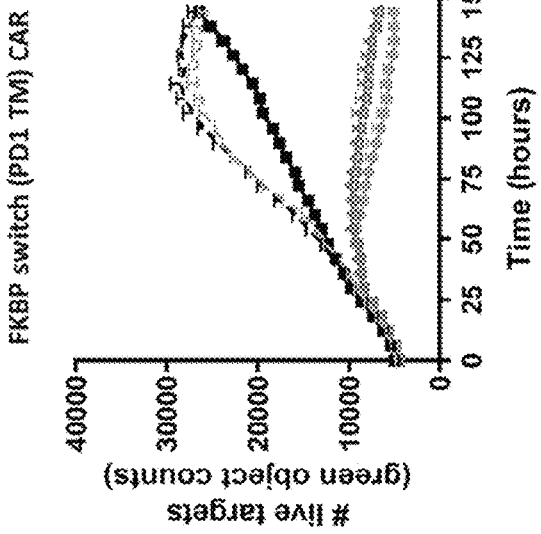
FIG. 34D depicts a graph summarizing results of an in vitro assay testing cytotoxicity of the indicated CAR-T cells.

FIGS. 34B-34D show that while control CAR T cells were not enhanced by AP1903 treatment, FKBP switches bearing either the TpoR TM domain or the PD1 TM domain were comparably enhanced in the presence of AP1903. Therefore, substitution with the PD1 TM domain can reduce basal FKBP switch activity, while preserving AP1903-inducible switch receptor activation and signaling.

We next tested whether substitution with the PD1 transmembrane region preserved AP1903-driven expansion of the chimeric receptor. Control CART cells or FKBP switch CAR T cells bearing either transmembrane variants were cultured with the indicated concentrations of AP1903, and in the absence of exogenous cytokines (unless specified in the case of positive controls) or target cells for 2 weeks. As a positive control, CAR T cells were alternatively supplemented with exogenous recombinant IL-7 (10 ng/mL; Miltenyi) and IL-12p70 (10 ng/mL; Biolegend) to mimic the dual IL-7R/IL12Rb2 outputs transmitted by FKBP switch activation. At the end of the 2-week culture, the number and quality of surviving CAR T cells were determined. Briefly, duplicate samples from each culture condition cells were harvested and stained using the Zombie NIR Fixable Viability Kit (Biolegend). Samples were washed with PBS, Fc blocked, then stained with the following antibody cocktail diluted in PBS+1% BSA: BUV395-conjugated anti-human CD3, BV510-conjugated anti-human CD8, BV605-conjugated human CD4 and FITC-conjugated v5 tag (for CAR detection), PE/Cy7-conjugated anti-human CD62L (Biolegend) and BV785-conjugated anti-human CD45RO (Biolegend). Finally, samples were washed in PBS and cell pellets were resuspended in 130 uL PBS+1% BSA containing 123count eBeads counting beads (Thermo Fisher) (10 uL counting beads in 120 uL PBS+1% BSA) prior to FACS analysis.

Figure 34F:
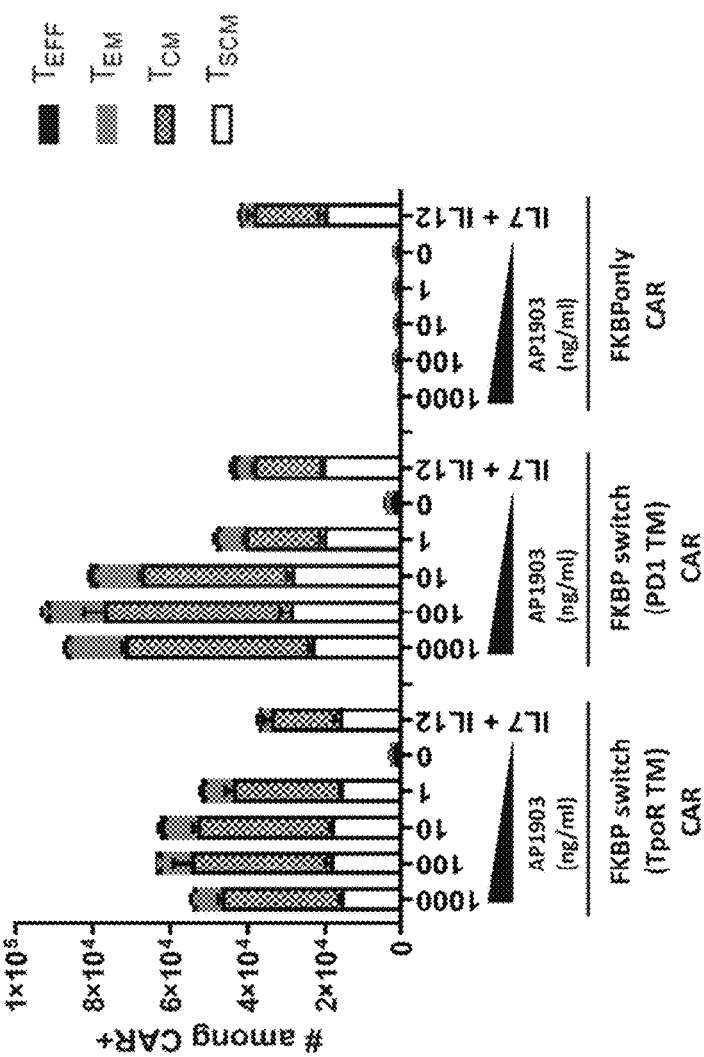
FIG. 34F depicts a graph summarizing results of an assay testing expansion of the indicated CAR-T cells.
Figure 34E:
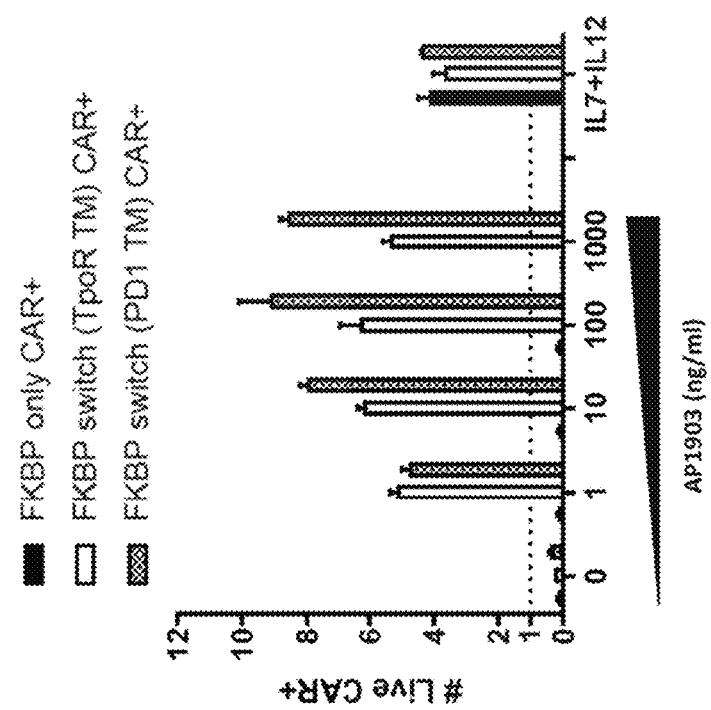
FIG. 34E depicts a graph summarizing results of an assay testing expansion of the indicated CAR-T cells.

FIG. 34E shows the number of live CAR+ T cells after 2 weeks of culture in the indicated concentrations of AP1903, or in exogenously supplemented IL-7 and IL-12p70. As expected, AP1903 did not support the expansion and survival control CAR T cells, and exogeneous IL7 and IL12p70 supported the expansion and survival of control and FKBP switch CAR T cells. In the presence of AP1903, FKBP switch CAR T cells with the PD1 transmembrane domain expanded equally or better than their counterparts bearing the TpoR transmembrane region.

FIG. 34F shows the number of CAR+ T cells in each memory compartment. Compared to their counterparts bearing the TpoR transmembrane region, FKBP switch CAR T cells with the PD1 transmembrane domain equal or better at maintaining Tscm and Tcm CAR+ cells in response to AP1903. These findings demonstrate that the PD1 transmembrane variant that has reduced basal signaling preserves switch receptor inducibility and functionality in the context of primary human CAR T cells.

Example 13: Improving CAR T Cell Manufacturing by AP1903-Driven CAR T Cell Expansion While lentiviruses have the ability to deliver relatively large cargos, increasing the payload—such as by co-expressing the FKBP switch—inevitably reduces viral titer and subsequent transduction efficiency. Conventional methods of CAR T cell manufacturing entails expanding transduced T cells in the presence of high doses of supplemented cytokines (e.g. IL-2, IL-7 and/or IL-15), which would expand both transduced (CAR+) and untransduced (CAR-) T cells in the same culture. As the activation of the FKBP switch can transmit a cytokine signal capable of driving CAR T cell expansion and enrichment, we leveraged this and hypothesized that substituting AP1903 for supplemented cytokines can overcome low transduction efficiencies during FKBP switch CAR T cell manufacturing.

On Day 0, Purified T cells were activated in X-Vivo-15 medium (Lonza) supplemented with 100 IU/mL human IL-2 (Miltenyi Biotec), 10% FBS (Hyclone), and human T Trans-Act (Miltenyi Biotec, Cat #130-111-160, 1:100 dilution) in a Grex-24 plate (Wilson Wolf, cat #80192M). On Day 2, T cells were resuspended at 0.5 million cells per mL in 1 mL of T cell transduction media per well of a Grex-24 plate (Wilson Wolf, cat #80192M). Lentiviral supernatants were made as described above and transduction was performed on Day 2. On Day 5 when transduction was complete, cells were washed to remove residual human IL-2, resuspended in fresh T cell expansion media, i.e., X-Vivo-15 supplemented with 5% human AB serum (Gemini Bio), and expanded in either 20 ng/ml human IL-2, or the indicated concentrations of AP1903, in Grex-24 well plates. Cells were expanded into larger G-Rex vessels (Wilson Wolf) as needed using T cell expansion media. On Days 5, 9 and 15, the enrichment of CAR+ T cells was determined by detecting the percentage of T cells that bound a FITC-conjugated v5 tag monoclonal antibody (Thermo Fisher) using flow cytometry.

Figure 35E:
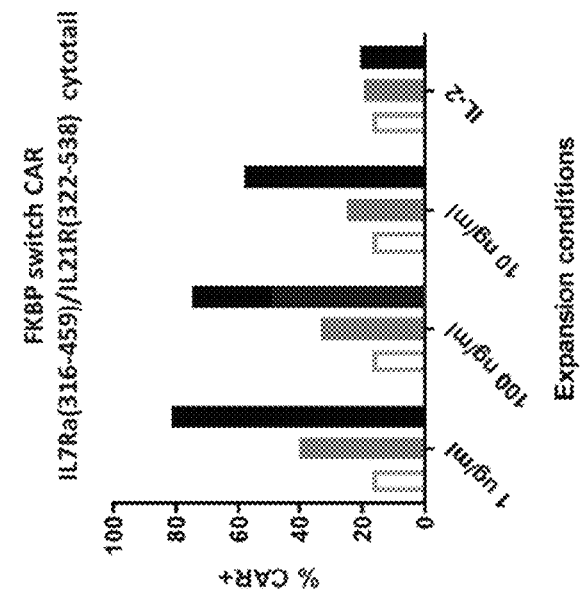
FIG. 35E depicts a graph showing expansion of CAR-T cells comprising the indicated inducible chimeric cytokine receptors.
Figure 35D:
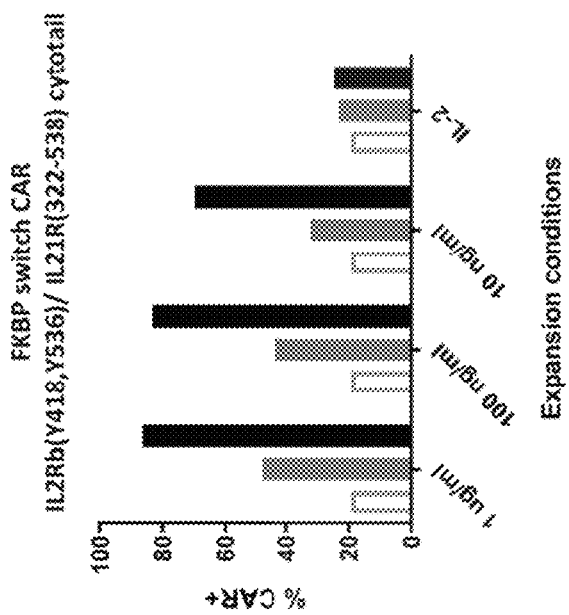
FIG. 35D depicts a graph showing expansion of CAR-T cells comprising the indicated inducible chimeric cytokine receptors.

FIG. 35A shows a schematic of the control BFP CAR and FKBP switch CARs with various cytotails used. FIGS. 35B-E show the percentage of CAR+ T cells that were expanded in either IL-2 or AP1903, as determined by FACS analysis on the indicated days. As expected, expansion in 20 ng/ml human IL-2 maintained a stable percentage of CAR+ T cells, due to equivalent expansion of both CAR+ and CAR- T cell populations within the culture. On the other hand, while AP1903 did not enrich BFP CART cells (FIG. 35B), the use of AP1903 in place of IL-2 progressively enriched for FKBP switch CAR T cells in a dose-dependent fashion between Days 5 and 14 (FIGS. 35C-E); Furthermore, effective CAR T cell enrichment could be attained with FKBP switches transmitting various signaling outputs via IL7Ra(316-459)/IL12Rb2(775-825) (FIG. 35C), IL2Rb (393-433, 518-551)/IL21R(322-538) (FIG. 35D) and IL7Ra (316-459)/IL21R(322-538) (FIG. 35E).

Example 14: Inducing Cytokine Signaling in Response to Antibodies and Other Multimerized Ligands/Inducers As dimerization can activate the inducible chimeric cytokine receptor, it is reasonable that with the proper ectodomain, antibodies (or antibody derived molecules), and multimerized ligands/inducers would activate signaling as well.

To evaluate activation by an antibody, we generated a chimeric cytokine receptor bearing the human OX40(1-214) ectodomain and tested its ability to signal in response to a clinical anti-OX40 antibody (GSK109) in a HEK293T cell-based Stat reporter assay. Briefly, 20,000 HEK293T cells were plated into each well of a poly-L-lysine-coated 96-well flat-bottom plate and allowed to adhere overnight. The OX40 ectodomain cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with the anti-OX40 antibody, GSK109, diluted in serum-free media, and Stat reporter activity was determined 5 hours post-treatment using the Dual-Glo Luciferase Assay System (Promega). Fold induction of Stat reporter activity was normalized to that of HEK293T cells transfected with all vectors except for the OX40 ectodomain cytokine receptor and that were left untreated. 4 wells were set up for each condition.

Figure 36A:
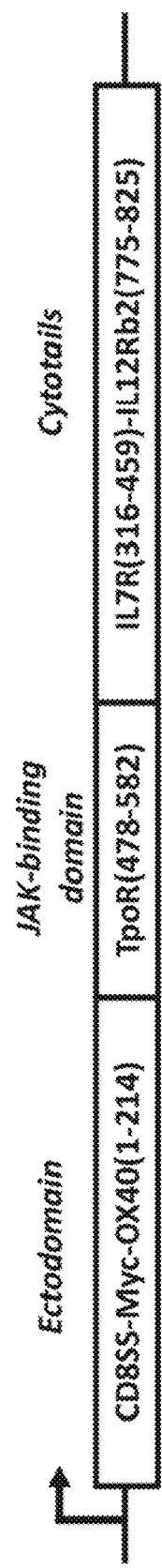
FIG. 36A depicts a schematic of an exemplary inducible chimeric cytokine receptor.
Figure 36B:
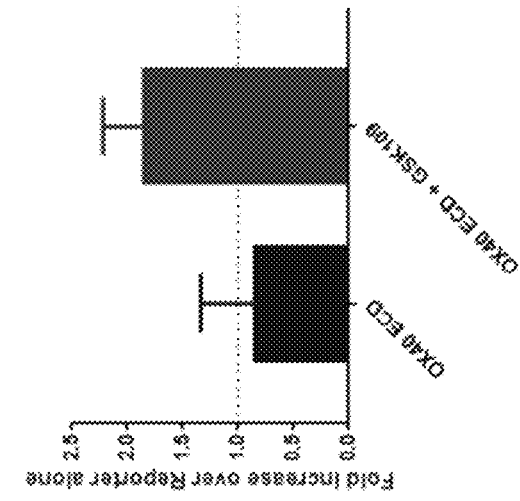
FIG. 36B depicts a graph summarizing results of a cell-based reporter assay testing function of the indicated inducible chimeric cytokine receptors.
Figure 36C:
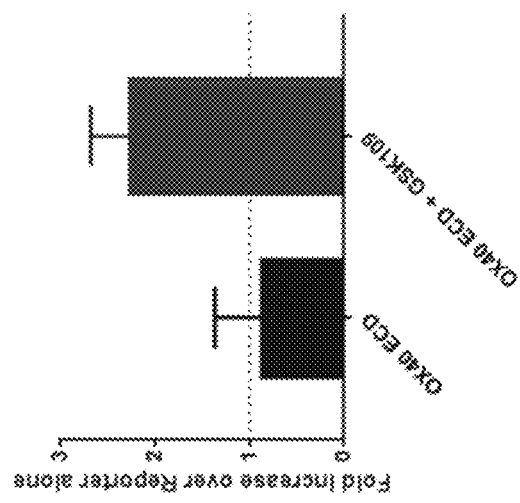
FIG. 36C depicts a graph summarizing results of a cell-based reporter assay testing function of the indicated inducible chimeric cytokine receptors.

FIG. 36A shows a schematic of a chimeric cytokine receptor bearing an OX40 ectodomain. FIGS. 36B-36C show the activation of cytokine signaling in response to an antibody. FIG. 36B-36C show Stat5 (36B) and Stat4 (36C) reporter activity in the absence and presence of the anti-OX40 antibody, GSK109. Antibody-mediated dimerization of the OX40 ectodomain induced downstream cytokine signaling, as reflected by an increase in Stat5 and Stat4 reporter activity.

To test if the panel of ligand inducers and ectodomains can be further extended beyond the AP1903-FKBP(F36V) pairing, we tested signaling in response to other multimeric ligand inducers. As the Tumor Necrosis Family (TNF) superfamily of ligands are trimers, they engage their respective receptors in a multimeric fashion. Therefore, we fused ectodomains derived from the TNFR2 superfamily receptors, such as BCMA(1-54), TACI(1-165) and BAFFR(1-78), to the transmembrane and signaling domains of our chimeric cytokine receptors, and tested signaling in response to soluble trimeric ligand. Briefly, 20,000 HEK293T cells were plated into each well of a poly-L-lysine-coated 96-well flat-bottom plate and allowed to adhere overnight. The chimeric cytokine receptor (2.5 ng), a Stat response element that drives Firefly Luciferase (100 ng; Promega) and Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with soluble BAFF or APRIL trimers diluted in serum-free media, and Stat reporter activity was determined 5 hours post-treatment using the Dual-Glo Luciferase Assay System (Promega). Fold induction of Stat reporter activity was normalized to that of HEK293T cells transfected with all vectors except for the OX40 ectodomain cytokine receptor and that were left untreated. 4 wells were set up for each condition.

Figure 37A:
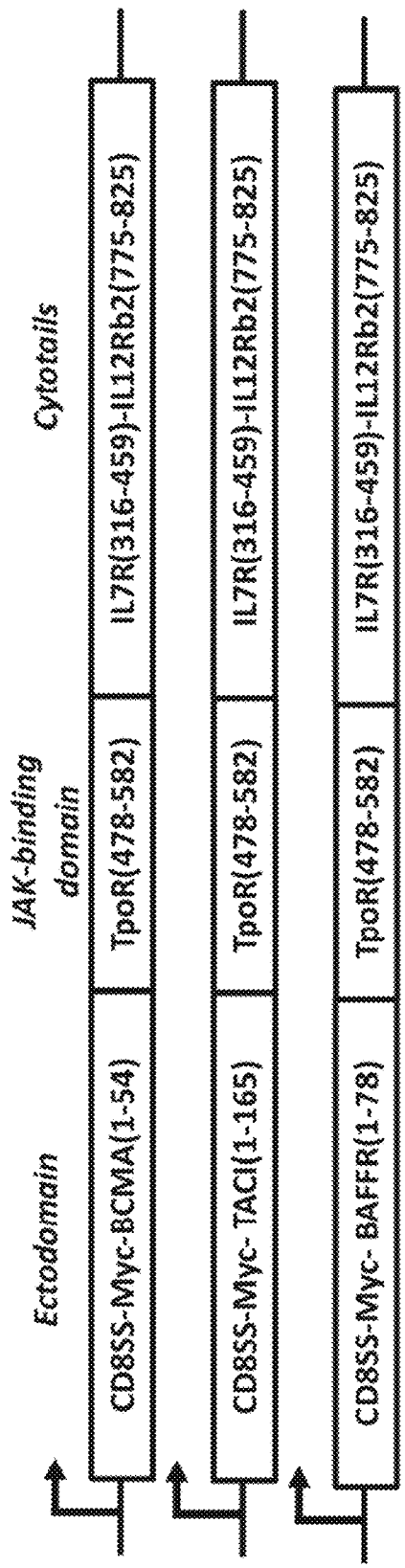
FIG. 37A depicts a schematic of exemplary inducible chimeric cytokine receptors.
Figure 37B:
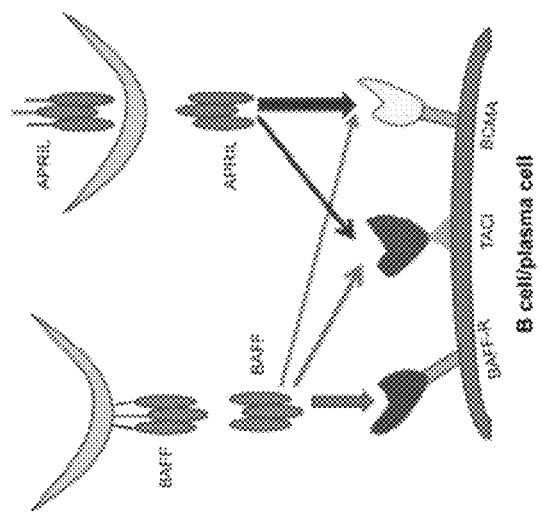
FIG. 37B is a schematic of the interactions between the receptors BCMA, TACI, and BAFFR with their ligands BAFF and APRIL.
Figure 37D:
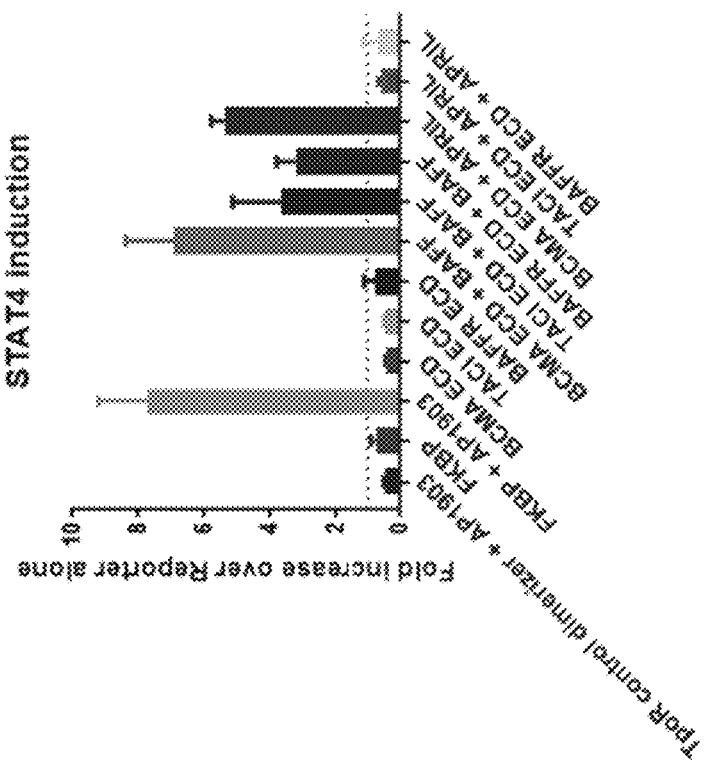
FIG. 37D depicts a graph summarizing results of a cell-based reporter assay testing function of the indicated inducible chimeric cytokine receptors.
Figure 37C:
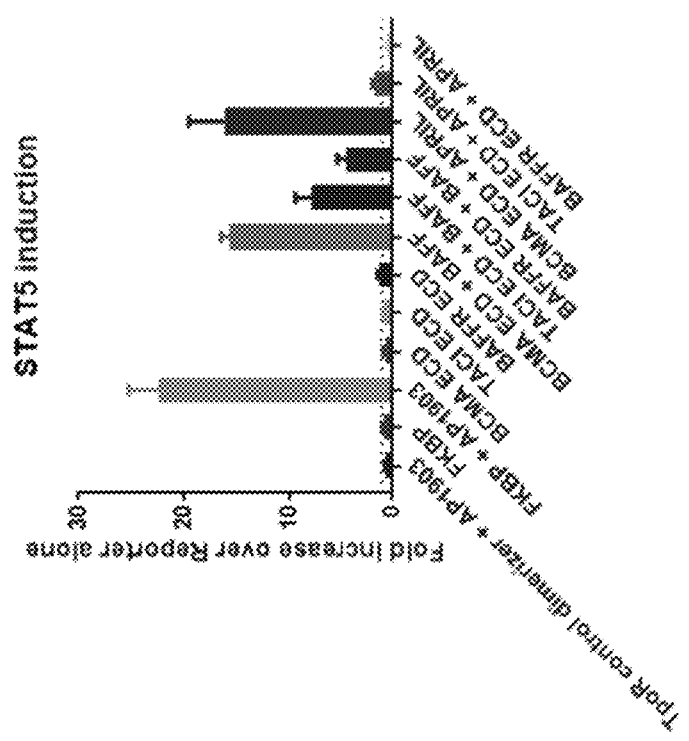
FIG. 37C depicts a graph summarizing results of a cell-based reporter assay testing function of the indicated inducible chimeric cytokine receptors.

FIG. 37A shows a schematic of the various ectodomains derived from the TNFR2 superfamily tested. FIG. 37B is a schematic of the interactions between the receptors BCMA, TACI and BAFFR with their ligands BAFF and APRIL (Drug Des Devel Ther. 2015 Jan. 7; 9:333-47.). FIGS. 37C-37D show the activation of cytokine signaling in response to multimeric ligand inducers. FIG. 37C-37D show Stat5 (37C) and Stat4 (37D) reporter activity in response to soluble BAFF and APRIL trimers. Multimerization of the respective chimeric cytokine receptors by soluble BAFF trimers induced Stat5 and Stat4 activation, and multimerization of the BCMA ectodomain cytokine receptor by soluble APRIL trimers induced downstream Stat activation.

Example 15: Optimizing the Signaling Strength and Sensitivity of the FKBP Switch by Modifying the TPOR TM Helix It is well established that the helical transmembrane (TM) region of TpoR is crucial for ligand-induced receptor signaling by controlling JAK2 activation. We hypothesized that in a chimeric cytokine switch where a different ectodomain (e.g. FKBP) is fused with the TpoR TM/JAK2-activating domain, the optimal structural conformation for receptor activation may be perturbed. Leveraging on the importance of the TM region in TpoR activity, we sought to increase the responsiveness of the FKBP switch by modifying the TpoR TM region. To this end, we generated FKBP switch variants with either deletions or insertions in the TpoR TM region and tested them in the HEK293T cell reporter assay.

Briefly, 20,000 HEK293T cells were plated into each well of a poly-L-lysine-coated 96-well flat-bottom plate and allowed to adhere overnight. An FKBP switch (2.5 ng), a Stat5 response element that drives Firefly Luciferase (100 ng; Promega) and Renilla Luciferase control reporter vector (1 ng; Promega) were mixed in a final volume of 5 uL in Opti-MEM (Gibco) ("DNA mix"). The FKBP switch bearing the wildtype TpoR transmembrane domain was used as the comparator. 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. 24 hours after transfection, cells were either left untreated, or treated with the indicated concentrations of AP1903 (APEX Bio) diluted in serum-free media. 24 hours after treatment, Stat5 reporter activity was evaluated using the Dual-Glo Luciferase Assay System (Promega). Fold induction of Stat5 reporter activity was normalized to that of HEK293T cells transfected with all vectors except for the switch receptor and that were left untreated.

Figure 38C:
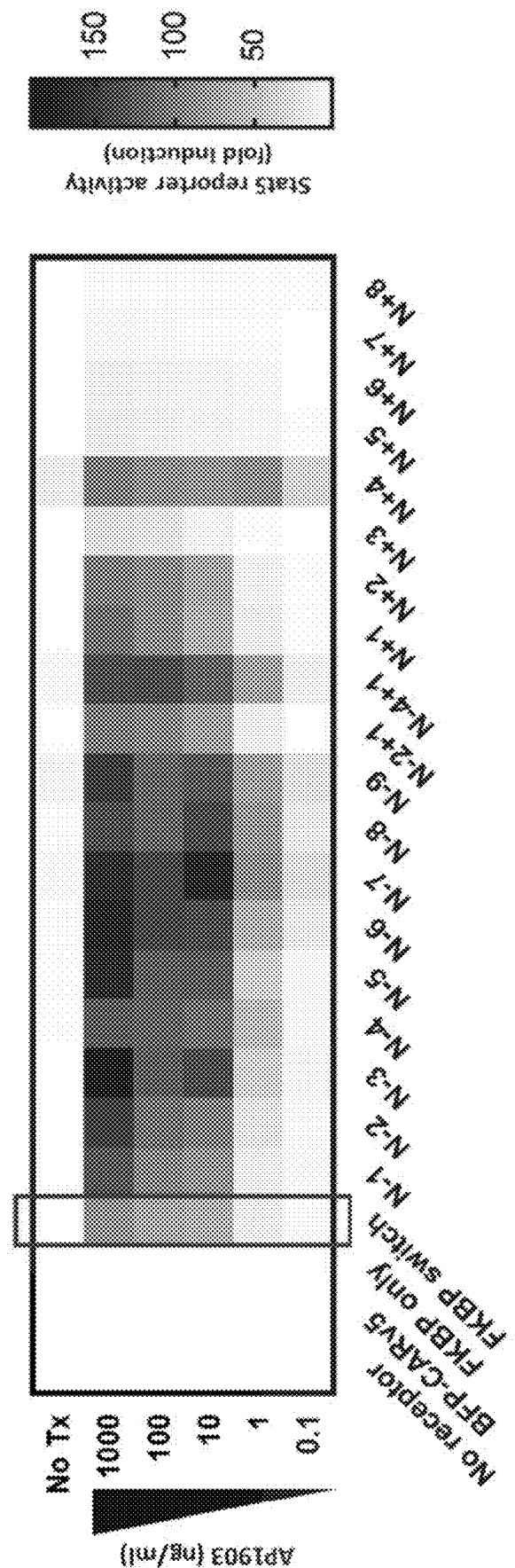
FIG. 38C depicts a graph summarizing results of a cell-based reporter assay testing function of the indicated inducible chimeric cytokine receptors.

FIGS. 38A-38C show the effect of TpoR transmembrane domain modifications on the strength and sensitivity of signaling by the FKBP switch.

FIGS. 38A-38B shows the amino acid sequences for the wildtype TpoR and the various TM deletion (FIG. 38A) or insertion (FIG. 38B) variants.

FIG. 38C shows the response of FKBP switch variants bearing TpoR TM deletions (FIG. 38A) and insertions (FIG. 38B) in the absence or presence of AP1903. Highlighted with a rectangular box is the FKBP switch bearing the wildtype TpoR TM domain from which TM variants were derived. Compared to the FKBP switch bearing the wildtype TpoR TM domain (i.e. FKBP switch), TpoR TM deletion variants such as TpoR(478-582; N-3), TpoR(478-582; N-5), TpoR(478-582; N-6) and TpoR(478-582; N-7) increased the strength of AP1903-induced Stat5 activity. Furthermore, several TpoR TM variants also increased the sensitivity in response to very low concentrations of AP1903 (i.e. 1 ng/ml or 0.1 ng/ml), with TpoR(478-582; N-7) and TpoR(478-582; N-9) being the most sensitive. These demonstrate that modulating the TpoR TM region enhanced the responsiveness and sensitivity of the FKBP switch to AP1903.

Example 16: Controlling CAR T Cell Differentiation Via Distinct and Combinatorial Cytotail Signal Outputs A. Combining Cytotails to Activate Additive Signaling Pathways Upon TCR activation, Ca+ mobilization leads to activation of NFAT and upregulation of pro-inflammatory targets (IL2, GzmB, etc.). Many of these promoters are activated not by NFAT alone but rather a heterotrimer of NFAT with AP-1 (coiled-coil of Fos and Jun). Exhaustion occurs with excessive antigen stimulation, and is thought to occur when the amount of activated NFAT supersedes the amount of AP-1 resulting in NFAT homo-dimers and activation of different promoters. One way to prevent exhaustion would be to increase the amount of AP-1 (Fos/Jun). Cytokine receptors such as IL2R and IL7R activate JNK (Jun Kinases) that phosphorylate and activate c-Jun. However, this alone is insufficient to upregulate AP-1 as Fos must also be upregulated and phosphorylated. The parallel MEK/ERK pathway leads to upregulation of Fos through Myc/Max, as well as direct phosphorylation of Fos. Thus a hypothetical receptor that activated both JNK and MEK/ERK would lead to gangbuster amounts of AP-1. The EGF receptor (EGFR) is one of the receptor tyrosine kinases well-known to activate the MEK/ERK signaling pathway. By using the EGFR cytotail, we demonstrate the ability to robustly activate Myc/Max, and consequently Fos. By combining the EGFR and IL7R cytotail, we demonstrate the successful induction of both AP-1 and Myc/Max signaling pathways, which prevent the terminal differentiation and exhaustion of CAR T cells.

To test the signaling pathways activated by different cytotails, we utilized a HEK293T cell reporter assay. Briefly, 20,000 HEK293T cells were plated into each well of a poly-L-lysine-coated 96-well flat-bottom plate and allowed to adhere overnight. An inducible cytokine receptor (2.5 ng), the respective transcription factor response element that drives Firefly Luciferase (100 ng; Promega) and a Renilla Luciferase control reporter vector (1 ng; Promega) were mixed in a final volume of 5 uL in Opti-MEM (Gibco) ("DNA mix"). 0.3 uL Lipofectamine 2000 (Invitrogen) in 5 uL Opti-MEM was incubated at room temperature for 5 minutes and then added to the DNA mix. The mixture was incubated at room temperature for 20 minutes and the total volume of 10 uL was added to each well containing HEK-293T. As a negative control, the FKBP ectodomain was coupled to the transmembrane and short intracellular region of TpoR(478-528) that lacked the JAK-binding domain and cytotail (i.e. TpoR CTRL). As a comparison, the FKBP ectodomain was coupled to the MyD88/CD40 signaling domains (henceforth referred to as "FKBP-MyD88-CD40"). 24 hours after transfection, cells were either left untreated, or treated with 1 ug/mL AP1903 (Apex Bio) diluted in serum-free media. 6 hours after AP1903 treatment, reporter activity was determined using the Dual-Glo Luciferase Assay System (Promega). Fold induction of Stat5 reporter activity was normalized to that of HEK293T cells transfected with all vectors except for the inducible cytokine receptor and that were left untreated.

Figure 39A:
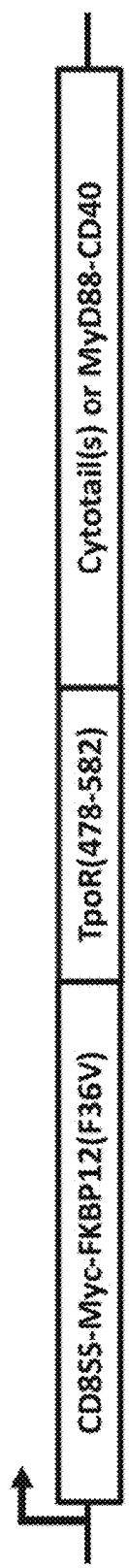
FIG. 39A depicts a schematic of an exemplary inducible chimeric cytokine receptor.

FIG. 39A shows a schematic of the chimeric receptors tested.

Figure 39B:
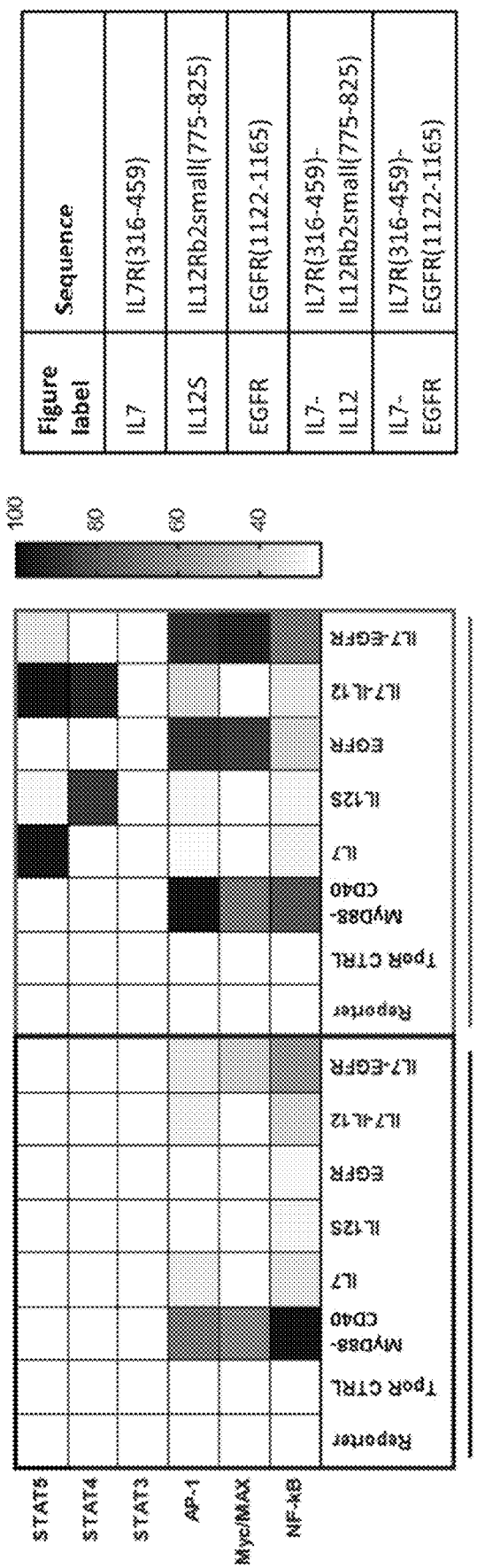
FIG. 39B depicts a graph summarizing results of a cell-based reporter assay testing function of the indicated inducible chimeric cytokine receptors.

FIG. 39B shows results of the luciferase assay readout for reporter activity in HEK293T cells using single and combinations of cytotails. Each row represents the respective transcription factor-responsive Firefly Luciferase reporter; each column represents the chimeric receptor bearing the respective cytotail/signaling domains. Each box depicts a fold induction, each row is normalized to the highest fold induction of the respective Firefly Luciferase reporter. As expected, single cytotail outputs activated the desired signaling pathways, with IL7R(316-459) activating Stat5, IL12Rb2small(775-825) activating Stat4, and EGFR(1122-1165) activating the AP-1 and Myc/Max pathways. When individual cytotails that on their own activated distinct signaling pathways were combined, an additive effect ensued—in the presence of AP1903, the IL7R(316-459)/IL12Rb2small(775-825) cytotails induced Stat5 and Stat4 activation, while the IL7R(316-459)/EGFR(1122-1165) cytotails induced Stat5 (albeit to a lower extent), AP-1 and Myc/Max activation. Compared to the inducible nature of FKBP-cytotail receptors, the FKBP-MyD88-CD40 receptor showed high basal signaling in the absence of AP1903.

B. Skewing T Cell Cytotoxic Effector Activity and Memory Differentiation Via Distinct Cytotail Outputs IL-12 signaling is well-known for promoting T cell cytotoxicity and effector differentiation; on the other hand, Figure Fb suggests that EGFR signaling may prevent T cell exhaustion and promote memory T cell generation. To test if distinct signaling pathways activated by different cytotails could control CAR T cell effector function and memory differentiation, we co-expressed FKBP switches bearing the same transmembrane and JAK2-binding domain with different cytotails, either singly or doubly in tandem.

To test whether different cytotail outputs influenced the effector function of CAR T cells, we performed a 4-day in vitro cytotoxicity assay. Briefly, 30,000 U87KO-EGFRvIII-nucRFP target cells were seeded and allowed to attach in 96-well plates with black walls and flat clear bottom in 50 uL RPMI containing 10% FBS (Hyclone), non-essential amino acids, sodium pyruvate and 20-25 mM HEPES. U87KO-EGFRvIII is a kind gift from Cellectis SA (Paris, France). U87KO-EGFRvIII was derived from the parental cell line, U87MG (ATCC), by first knocking out endogenous wildtype EGFR using Transcription Activator-Like Effector Nucleases (TALEN), and then stably overexpressing full-length human EGFRvIII via lentiviral transduction. To facilitate target cell imaging via the IncuCyte Live Cell Analysis Imaging System, U87KO-EGFRvIII-nucRFP target cells were derived from U87KO-EGFRvIII by a second lentiviral transduction with IncuCyte NucLight Red Lentivirus Reagent (Sartorius). EGFRvIII CAR (2173 scFv) T cells bearing an FKBP switch with the respective cytotails were thawed and added to plated target cells at an Effector: Target (E:T) ratio of 1:8. As a comparison, CAR T cells coexpressing FKBP-MyD88-CD40 were included. Wells were either left untreated or treated with 500 ng/ml AP1903 (ApexBio). The number of live target cells at each timepoint was determined by enumerating the number of live nuclearRFP+ cells using the Incucyte Live Cell Analysis Imaging System. Duplicate wells were set up for each condition.

At the end of the 4-day cytotoxicity assay, plates were spun down and supernatents were collected for the analysis of cytokine release using the MSD assay (Meso Scale Discovery).

FIGS. 40A-40F show the results from the in vitro cytotoxicity assay of FKBP switches bearing different cytotails singly or doubly in tandem, in the absence or presence of AP1903.

Figure 40A:
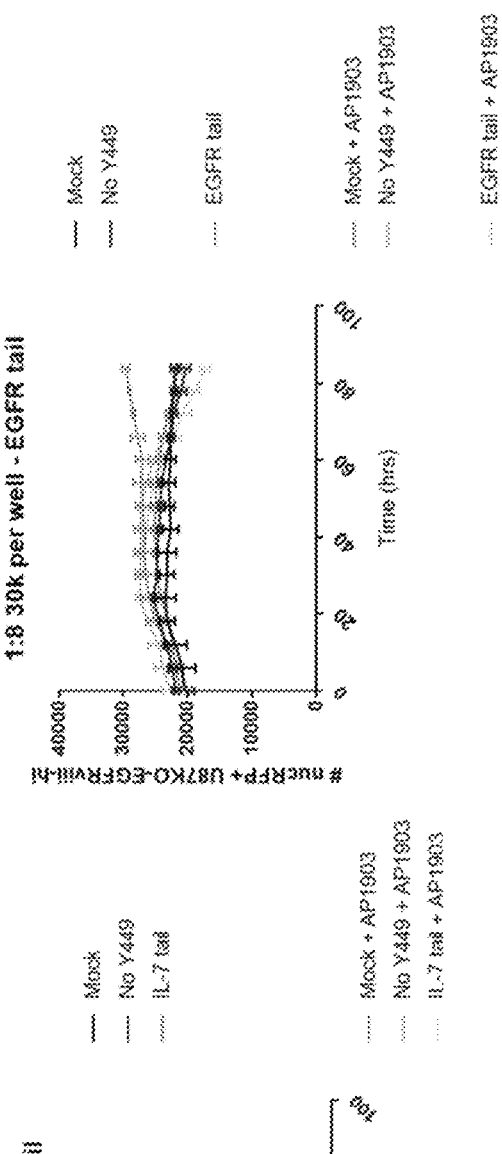
FIG. 40A depicts a graph summarizing results of an in vitro cytotoxicity assay of CAR-T cells comprising the indicated inducible chimeric cytokine receptor.
Figure 40B:
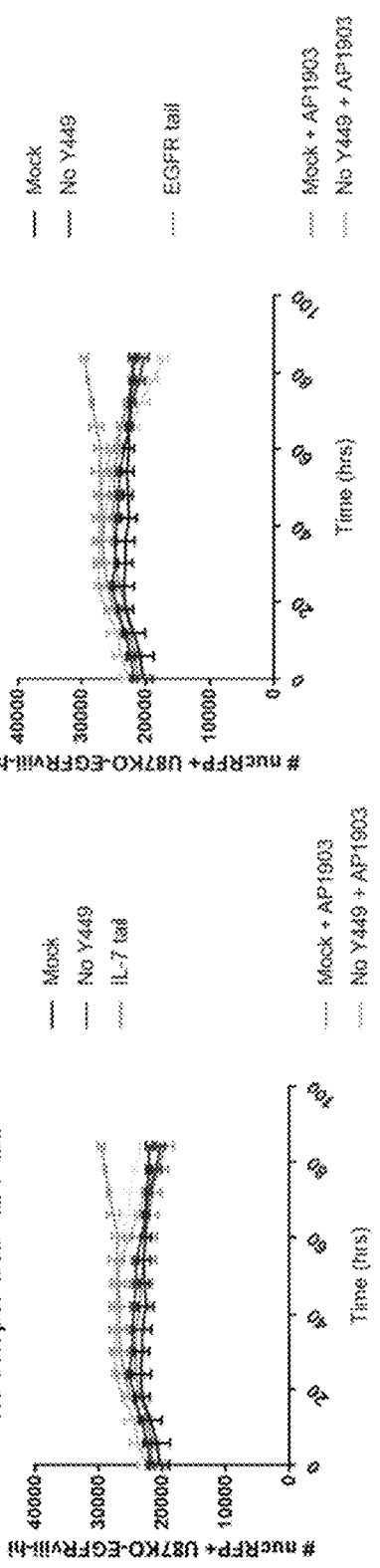
FIG. 40B depicts a graph summarizing results of an in vitro cytotoxicity assay of CAR-T cells comprising the indicated inducible chimeric cytokine receptor.
Figure 40C:
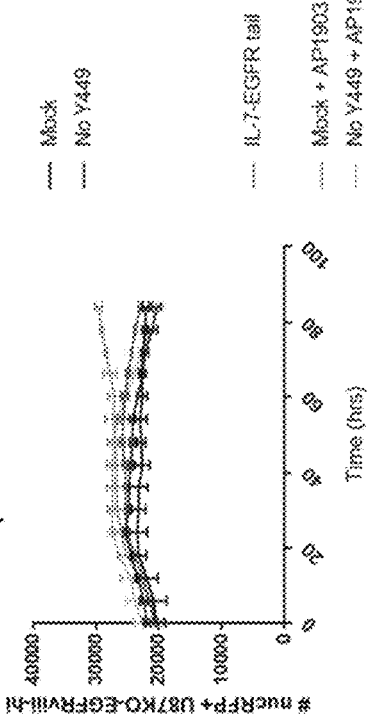
FIG. 40C depicts a graph summarizing results of an in vitro cytotoxicity assay of CAR-T cells comprising the indicated inducible chimeric cytokine receptor.

FIGS. 40A-40C show the cytotoxic activity of the stem cell/central memory (Tscm/Tcm) T cell-promoting cytotails tested, i.e. IL7R(316-459) and EGFR(1122-1165). Within the relatively short timeframe of 4 days, the IL7R(316-459) and EGFR(1122-1165) —either singly or combined—did not enhance CAR T cell cytotoxicity in the presence of AP1903. This may be expected because although T cells of the Tscm/Tcm memory phenotype do self-renew long-term and survive longer, but also exhibit a delay in executing cytotoxic effector functions.

Figure 40D:
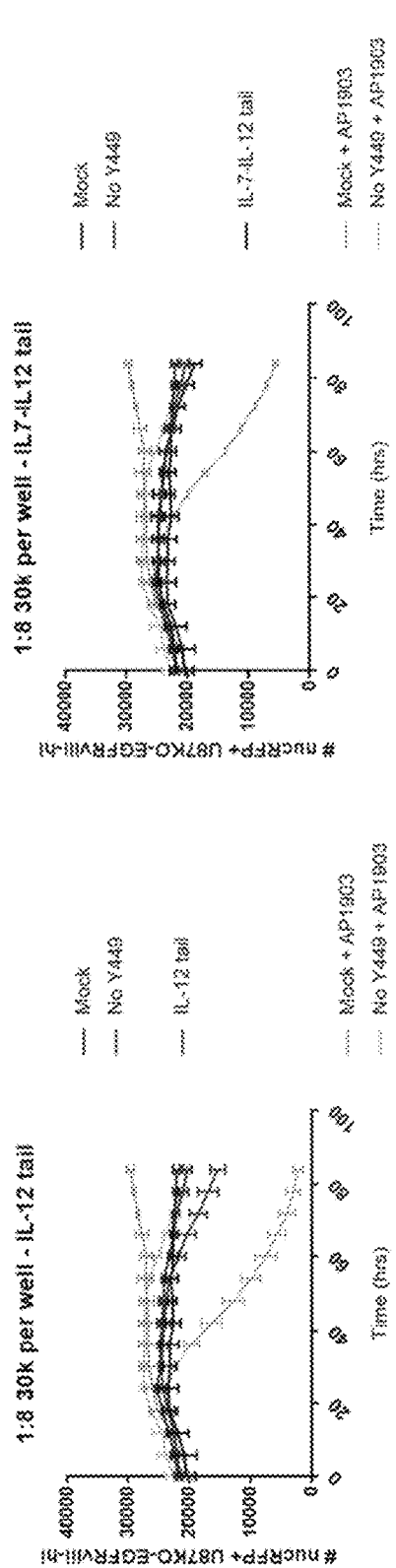
FIG. 40D depicts a graph summarizing results of an in vitro cytotoxicity assay of CAR-T cells comprising the indicated inducible chimeric cytokine receptor.
Figure 40E:
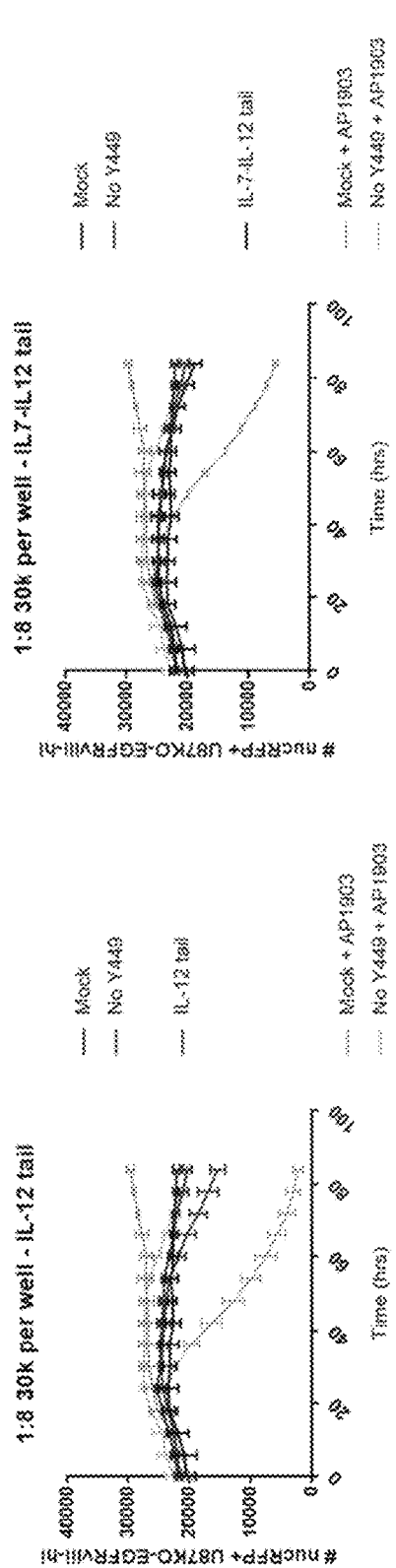
FIG. 40E depicts a graph summarizing results of an in vitro cytotoxicity assay of CAR-T cells comprising the indicated inducible chimeric cytokine receptor.

FIGS. 40D-40E show the cytotoxic activity of the IL12Rb2small(775-825) cytotail, which mimics IL-12 signaling to promote effector memory/effector (Tem/Temra) T cell differentiation. The IL12Rb2small(775-825) cytotail—either alone or when combined with IL7R(316-459) —enhances CART cell cytotoxic potency in the presence of AP1903.

Figure 40F:
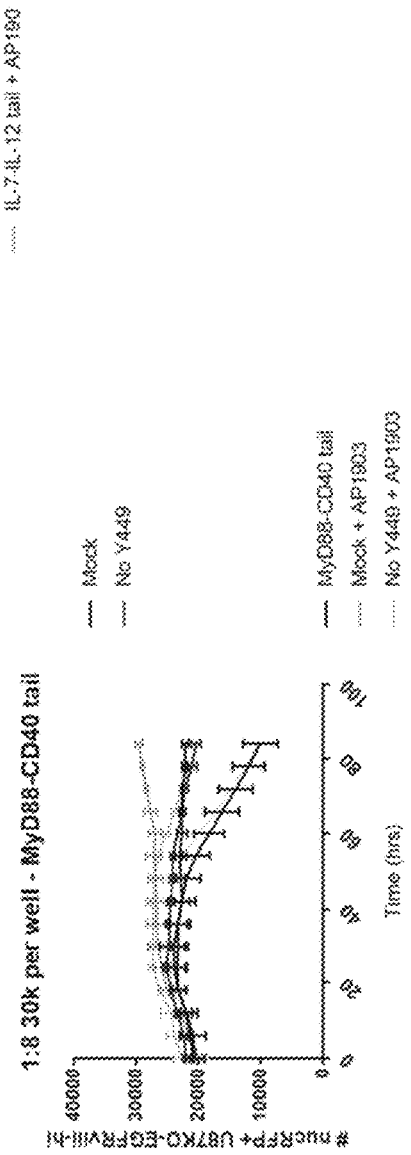
FIG. 40F depicts a graph summarizing results of an in vitro cytotoxicity assay of CAR-T cells comprising the indicated chimeric receptor.

FIG. 40F shows the cytotoxic activity of CAR T cells bearing FKBP-MyD88-CD40. Unlike the cytotails in FIGS. 40A-40E, CAR T cells bearing FKBP-MyD88-CD40 showed enhanced killing activity in the absence of AP1903. Moreover, the addition of AP1903 did not further enhance cytotoxicity, suggesting that FKBP-MyD88-CD40 receptor is one with a high basal activity and that lacks inducibility.

Figure 41A:
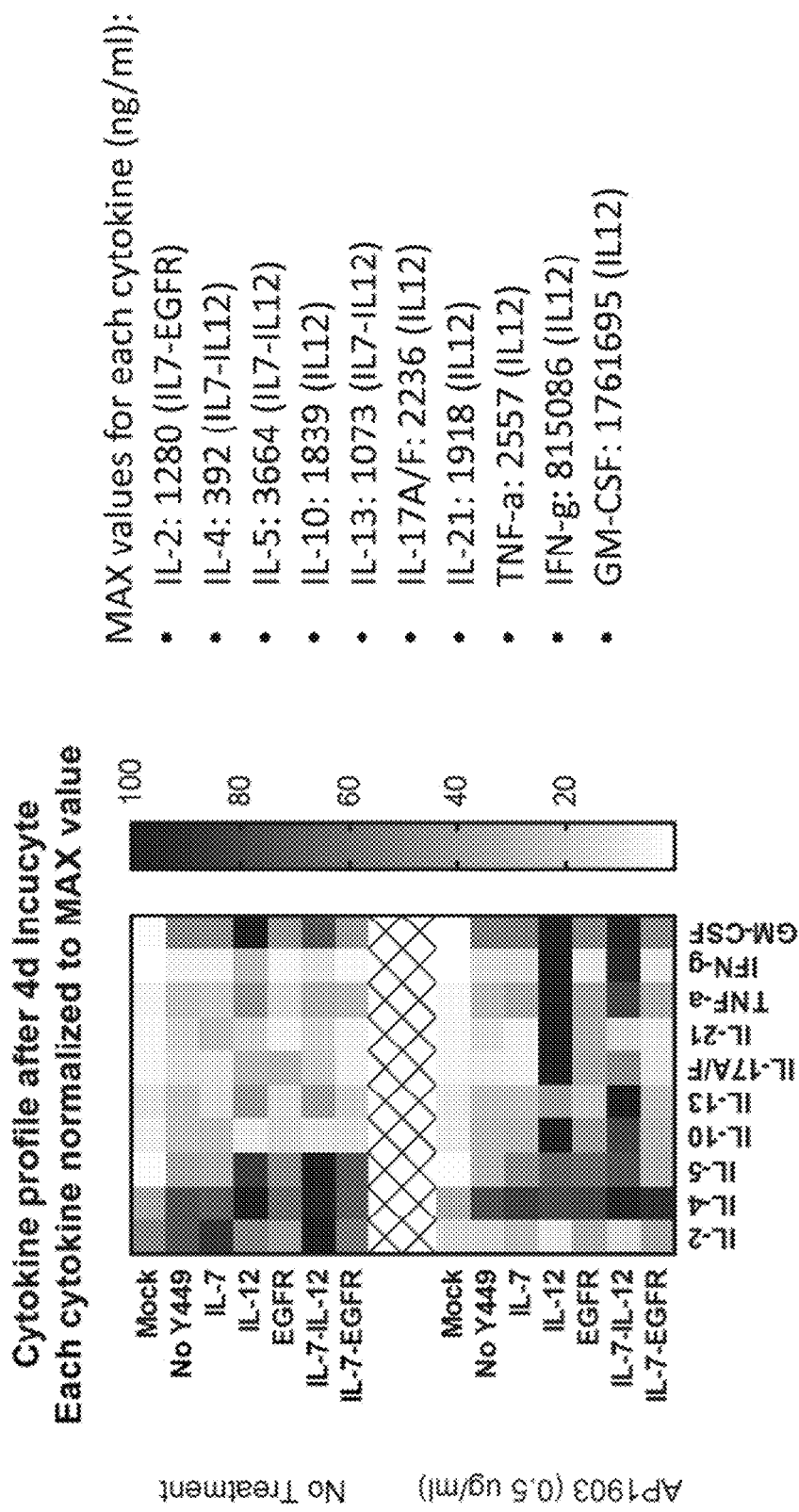
FIG. 41A depicts a graph summarizing the effects of the indicated inducible chimeric cytokine receptors on cytokine release.
Figure 41B:
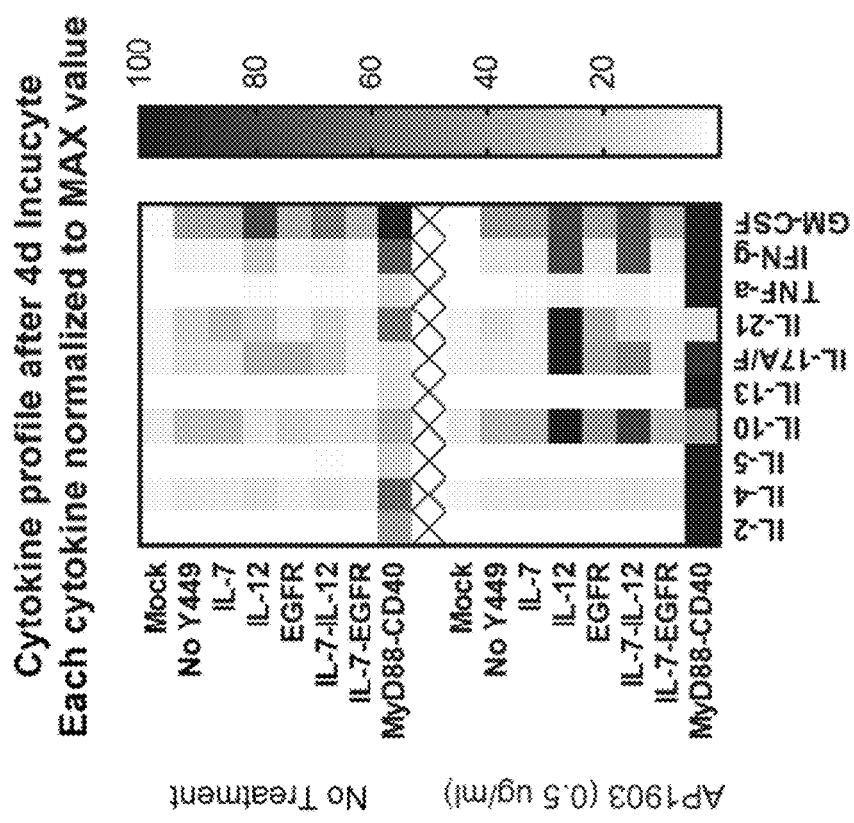
FIG. 41B depicts a graph summarizing the effects of the indicated inducible chimeric cytokine receptors on cytokine release.

FIGS. 41A-41B show the levels of cytokines in the culture supernatents at the end of the 4-day cytotoxicity assay, in the absence and presence of AP1903. Each row shows the respective cytotail in the absence or presence of AP1903, each column shows the respective cytokine assayed. Each column is normalized to the highest concentration of the respective cytokine assayed, which was set as 100%.

FIG. 41A shows cytokine release of all cytotails, but not including the FKBP-MyD88-CD40 receptor. In the presence of AP1903, FKBP switches containing the effector-promoting IL12Rbsmall(775-825) cytotail released elevated amounts of pro-inflammatory cytokines, including IL-17A/F, IL-21, TNFa and IFNg. Interestingly, the IL12Rbsmall (775-825) cytotail also led to increased IL-10 secretion, which likely arose from a negative-feedback mechanism in response to strong inflammatory signals.

FIG. 41B shows cytokine release of all cytotails, as well as the FKBP-MyD88-CD40 receptor. Compared to FKBP switches bearing cytotails, the FKBP-MyD88-CD40 receptor secreted elevated levels of cytokines even in the absence of AP1903, a result consistent with its high basal activity.

To test whether different cytotail outputs influenced the memory differentiation and long-term survival of CAR T cells, we performed an AP1903-driven growth assay. CAR T cells bearing the indicated chimeric receptors were thawed and the percentages of CAR+ cells were normalized to the sample with the lowest transduction efficiency (i.e. 20% CAR+) by adding non-transduced T cells. Cells were either left untreated, or treated with 500 ng/ml of AP1903, and in the absence of exogenous cytokines (unless specified in the case of positive controls) or target cells for 2 weeks. As positive controls, CAR T cells were alternatively supplemented with either exogenous recombinant IL-7 or IL-2 (10 ng/mL each; Miltenyi). On Day 5 of the AP1903-driven growth assay, supernatents were sampled for the analysis of cytokine release using the MSD assay (Meso Scale Discovery). At the end of the 2-week culture, the memory and exhaustion phenotypes of surviving CAR T cells were determined. Briefly, duplicate samples from each culture condition cells were harvested and stained using the Zombie NIR Fixable Viability Kit (Biolegend). Samples were washed with PBS, Fc blocked, then stained with the following antibody cocktail diluted in PBS+1% BSA: BUV395-conjugated anti-human CD3, BV510-conjugated anti-human CD8, BV605-conjugated human CD4 and FITC-conjugated v5 tag (for CAR detection), PE/Cy7-conjugated anti-human CD62L (Biolegend), BV785-conjugated anti-human CD45RO (Biolegend), APC-conjugated anti-human PD-1 (Biolegend), BV711-conjugated anti-human Tim-3 (Biolegend) and PerCP/eFluor710-conjugated anti-human Lag-3 (eBioscience). Finally, samples were washed in PBS and cell pellets were resuspended in PBS+1% BSA for FACS analysis.

Figure 42A:
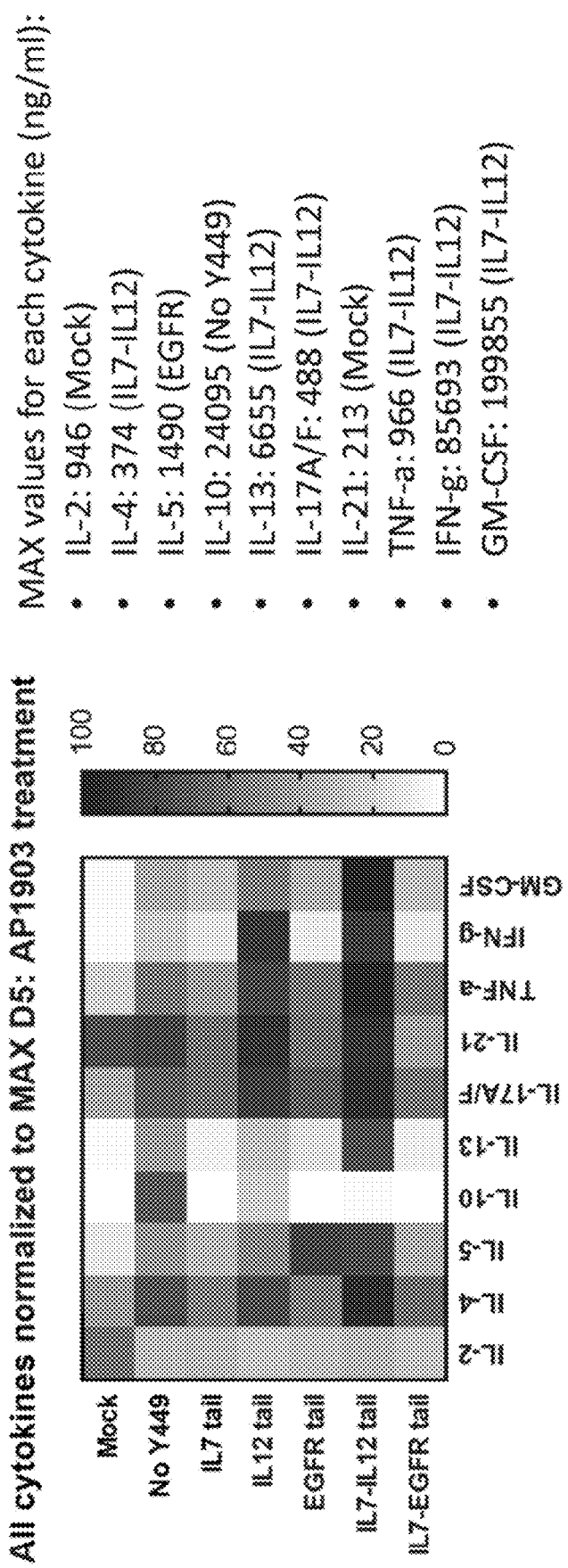
FIG. 42A depicts a graph summarizing the effects of the indicated inducible chimeric cytokine receptors on cytokine release.
Figure 42B:
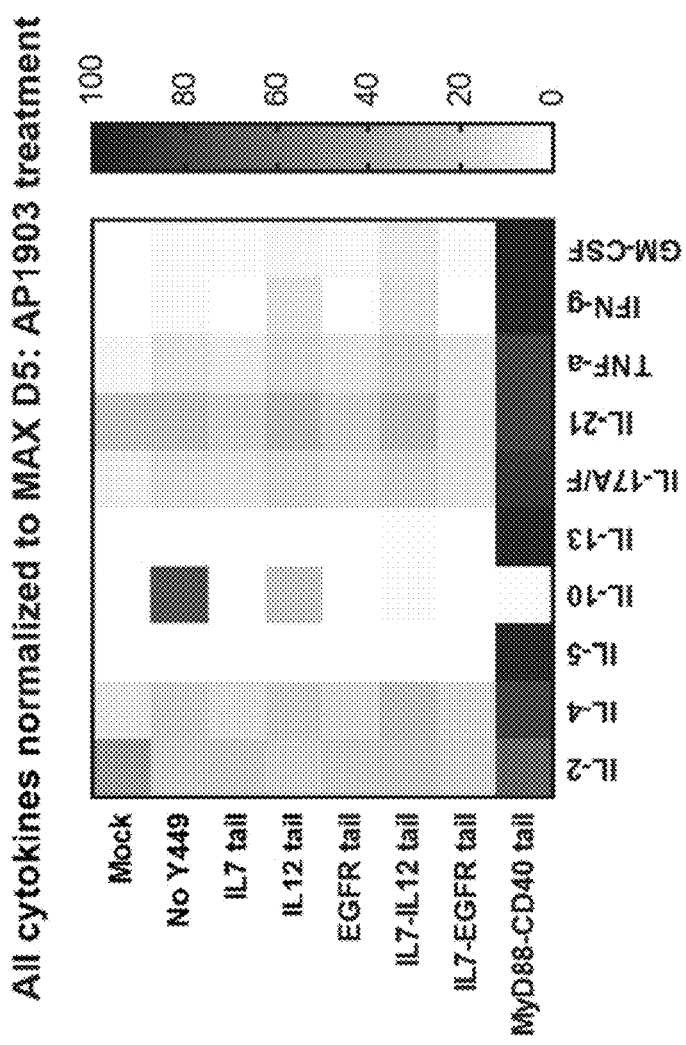
FIG. 42B depicts a graph summarizing the effects of the indicated inducible chimeric cytokine receptors on cytokine release.

FIGS. 42A-42B show the levels of cytokines in the culture supernatants on Day 5 of AP1903-driven growth, in presence of AP1903. Each row shows the respective signaling domain in presence of AP1903, each column shows the respective cytokine assayed. Each column is normalized to the highest concentration of the respective cytokine assayed, which was set as 100%.

FIG. 42A shows cytokine release of all cytotails, but not including the FKBP-MyD88-CD40 receptor. Cytotails containing IL12Rbsmall(775-825) secrete elevated amounts of pro-inflammatory cytokines, including IL-17A/F, IL-21, TNFa and especially IFNg.

FIG. 42B shows cytokine release of all cytotails, as well as the FKBP-MyD88-CD40 receptor. As compared to the FKBP-MyD88-CD40 receptor, cytokine release by FKBP-cytotail chimeric receptors during AP1903-driven growth were lower overall.

Figure 43:
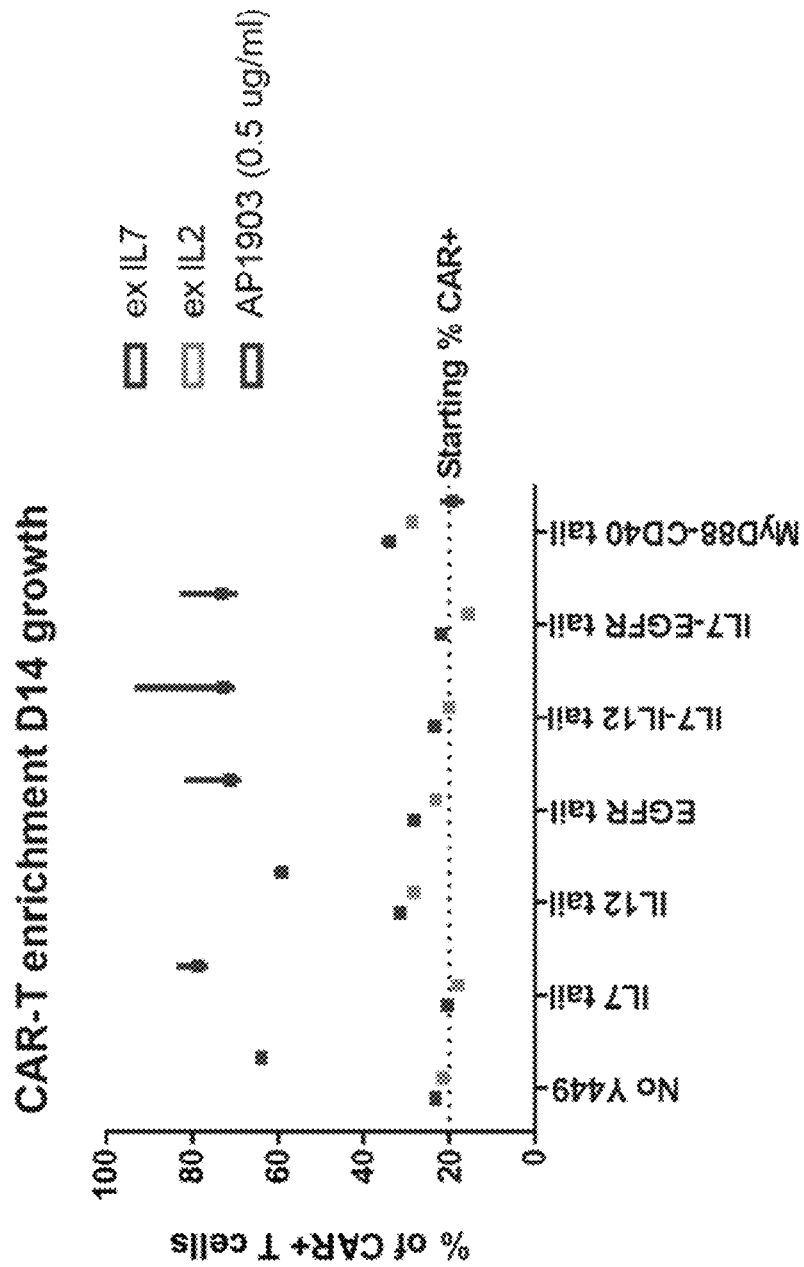
FIG. 43 depicts a graph summarizing enrichment of CAR-T cells comprising the indicated chimeric cytokine receptors.
Figure 44A:
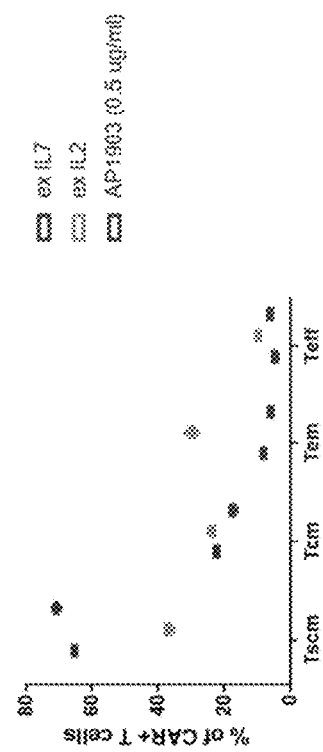
FIG. 44A depicts a graph summarizing the memory subset distribution of CAR-T cells comprising the indicated chimeric cytokine receptor.
Figure 44B:
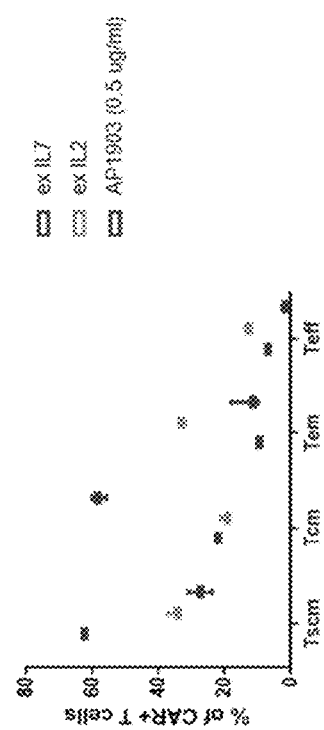
FIG. 44B depicts a graph summarizing the memory subset distribution of CAR-T cells comprising the indicated chimeric cytokine receptor.
Figure 44C:
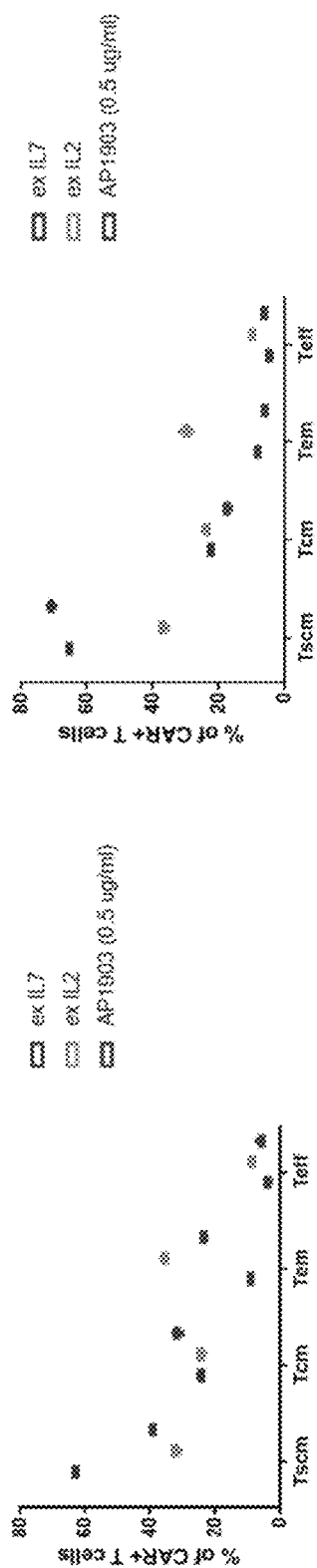
FIG. 44C depicts a graph summarizing the memory subset distribution of CAR-T cells comprising the indicated chimeric cytokine receptor.
Figure 44D:
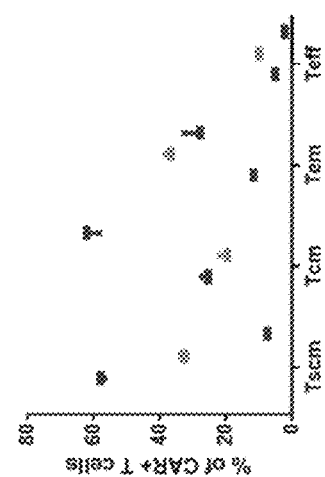
FIG. 44D depicts a graph summarizing the memory subset distribution of CAR-T cells comprising the indicated chimeric cytokine receptor.
Figure 45A:
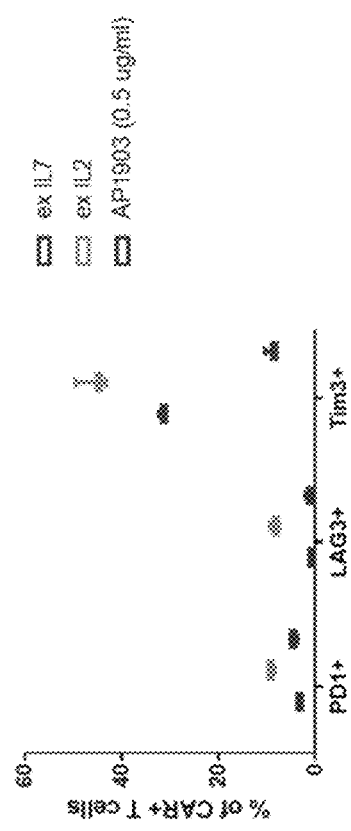
FIG. 45A depicts a graph summarizing the effect of the indicated inducible chimeric cytokine receptor on cell phenotype.
Figure 45C:
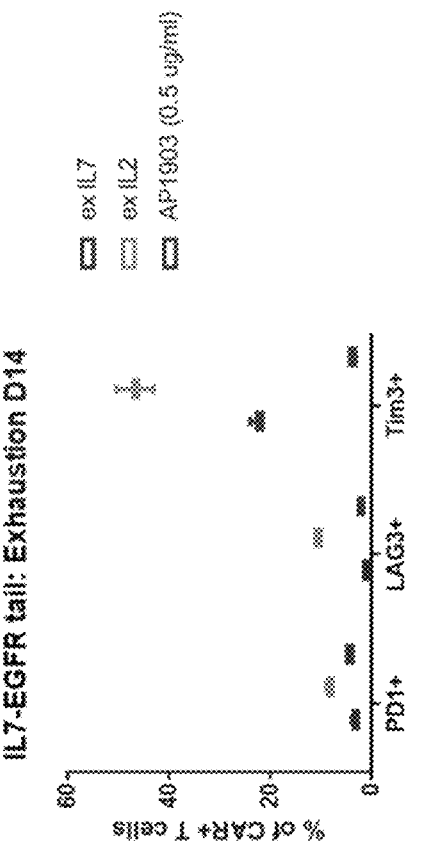
FIG. 45C depicts a graph summarizing the effect of the indicated inducible chimeric cytokine receptor on cell phenotype.
Figure 45B:
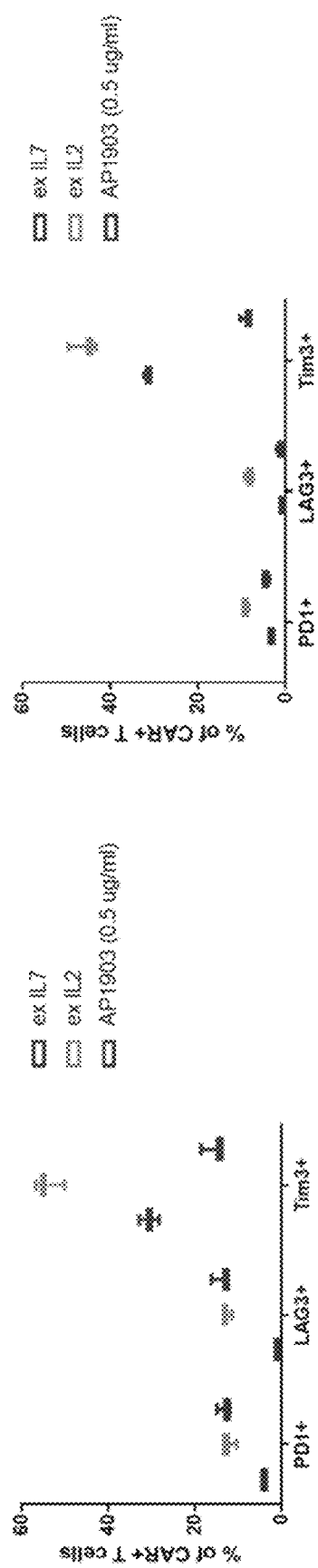
FIG. 45B depicts a graph summarizing the effect of the indicated inducible chimeric cytokine receptor on cell phenotype.
Figure 45D:
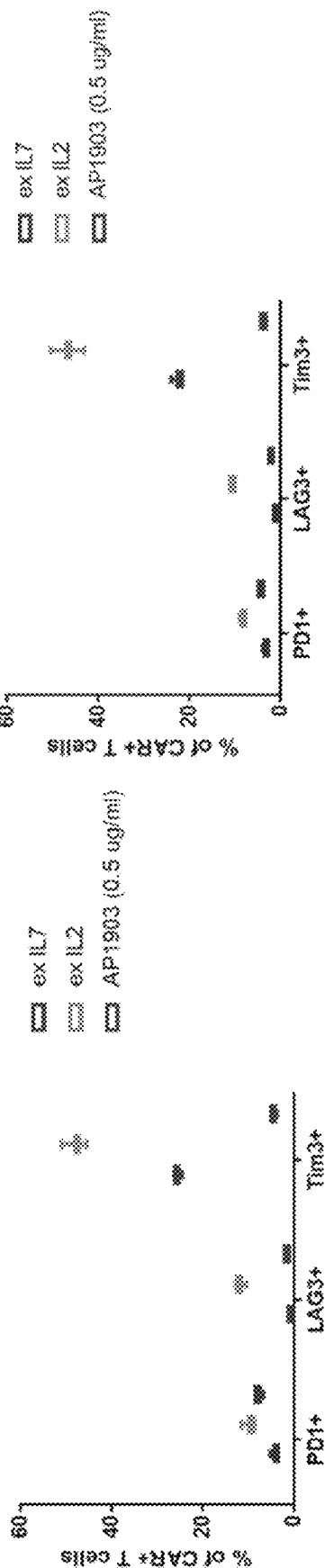
FIG. 45D depicts a graph summarizing the effect of the indicated inducible chimeric cytokine receptor on cell phenotype.

FIG. 43 shows the AP1903-driven enrichment of cytotail-bearing CAR T cells. The dotted line indicates the percentage of CAR+ cells seeded at the beginning of the assay (i.e. 20%). As expected, treatment with exogenous recombinant IL-7 or IL-2 promoted the expansion and survival of both CAR+ and CAR− T cells within the same culture, leading to the stable maintenance of CAR+ cells at ~20%. In contrast, treatment with AP1903 selected and enriched for CAR T cells expressing the FKBP-cytotail receptors, suggesting that the growth and survival advantage is CAR+ T cell-specific.

FIGS. 44A-44G show the memory subset distribution of CAR T cells on Day 14 of AP1903-driven expansion. Compared to the IL7R(424-459; Y456F) cytotail that abrogates Stat5 activity (FIG. 5B), the Stat5-competent IL7R (316-459) cytotail promoted the enrichment of Tscm CAR+ T cells to an extent equal or better than exogenous recombinant IL-7. Furthermore, compared to treatment with exogenous recombinant IL-7 or IL-2, AP1903-induced activation of the EGFR(1122-1165) cytotail—either alone or in combination with IL7R(316-459) —resulted in an enrichment of the Tcm CAR+ T cell population, suggesting that EGFR (1122-1165) cytotail signaling promotes Tcm differentiation.

FIGS. 45A-45G show the exhaustion phenotype of CAR+ T cells on Day 14 of AP1903-driven expansion. Compared to the IL7R(424-459; Y456F) cytotail that abrogates Stat5 activity (FIG. 5B), the Stat5-competent IL7R(316-459) cytotail effectively suppressed the expression of PD-1, Tim-3 and Lag-3 to an extent equal or better than exogenous recombinant IL-7. Furthermore, compared to treatment with exogenous recombinant IL-7 or IL-2, AP1903-induced activation of the EGFR(1122-1165) cytotail—either alone or in combination with IL7R(316-459) —suppressed the expression of Tim-3 and Lag-3.

Taken together, the enrichment of long-lived CAR T cells may be achieved by incorporating memory-promoting and exhaustion-preventing cytotails, such as IL7R(316-459) and/or EGFR(1122-1165); whereas CAR T cells with potent and immediate cytotoxic functions may be favored by incorporating effector-promoting cytotails, such as Il12Rb2small(775-825).

Although the disclosed teachings have been described with reference to various applications, methods, kits, and compositions, it will be appreciated that various changes and modifications can be made without departing from the teachings herein and the claimed invention below. The foregoing examples are provided to better illustrate the disclosed teachings and are not intended to limit the scope of the teachings presented herein. While the present teachings have been described in terms of these exemplary embodiments, the skilled artisan will readily understand that numerous variations and modifications of these exemplary embodiments are possible without undue experimentation. All such variations and modifications are within the scope of the current teachings.

All references cited herein, including patents, patent applications, papers, text books, and the like, and the references cited therein, to the extent that they are not already, are hereby incorporated by reference in their entirety. In the event that one or more of the incorporated literature and similar materials differs from or contradicts this application, including but not limited to defined terms, term usage, described techniques, or the like, this application controls.

The foregoing description and Examples detail certain specific embodiments of the invention and describes the best mode contemplated by the inventors. It will be appreciated, however, that no matter how detailed the foregoing may appear in text, the invention may be practiced in many ways and the invention should be construed in accordance with the appended claims and any equivalents thereof.

---

SEQUENCE LISTING (334 sequences)

SEQ ID NO: 1 - protein, 422 aa, Artificial Sequence
  Description of Artificial Sequence: Synthetic polypeptide
  CD8 SS-Myc-FKBP(F36V)-EpoR(237-508;L241G,L242P)-V5
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACSIPNPLLGLDST

SEQ ID NO: 2 - protein, 461 aa, Artificial Sequence
  Description of Artificial Sequence: Synthetic polypeptide
  V5-EpoR(273-508)-FKBP(F36V)-FKBP(F36V)
IPNPLLGLDSTSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 3 - protein, 461 aa, Artificial Sequence
  Description of Artificial Sequence: Synthetic polypeptide
  V5-EpoR(273-508)-FKBP(E31G,36V,R71G,K105E)-FKBP(E31G,36V,R71G, K105E)
IPNPLLGLDSTSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACSMGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 4 - protein, 527 aa, Artificial Sequence
  Description of Artificial Sequence: Synthetic polypeptide
  CD8 SS-Myc-FKBP(F36V)-EpoR(237-338;L241G,L242P)-GHR(353-638)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 5 - protein, 460 aa, Artificial Sequence
  Description of Artificial Sequence: Synthetic polypeptide
  CD8 SS-Myc-FKBP(F36V)-EpoR(237-338;L241G,L242P)-IL2Rb(333-551)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 6 - protein, 385 aa, Artificial Sequence
  Description of Artificial Sequence: Synthetic polypeptide
  CD8 SS-Myc-FKBP(F36V)-EpoR(237-338;L241G,L242P)-IL7R(316-459)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 7 - protein, 390 aa, Artificial Sequence
  Description of Artificial Sequence: Synthetic polypeptide
  CD8 SS-Myc-FKBP(F36V)-EpoR(237-338;L241G,L242P)-IL12Rb2(714-862)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 8 - protein, 292 aa, Artificial Sequence
  Description of Artificial Sequence: Synthetic polypeptide
  CD8 SS-Myc-FKBP(F36V)-EpoR(237-338;L241G,L242P)-IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCSDPKPENPACPWTVLPAGDLPTHDGYLPSNIDDLPSHEAPLADSLEELEPQ

SEQ ID NO: 9 - protein, 458 aa, Artificial Sequence
  Description of Artificial Sequence: Synthetic polypeptide
  CD8 SS-Myc-FKBP(F36V)-EpoR(237-338;L241G,L242P)-IL21R(322-538)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 10 - protein, 447 aa, Artificial Sequence
  Description of Artificial Sequence: Synthetic polypeptide
  CD8 SS-Myc-FKBP(F36V)-EpoR(237-338;L241G,L242P)-IFNAR2(310-515)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCKKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 11 - protein, 462 aa, Artificial Sequence
  Description of Artificial Sequence: Synthetic polypeptide
  CD8 SS-Myc-FKBP(F36V)-EpoR(237-338;L241G,L242P)-IFNAR1(300-520)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 12 - protein, 444 aa, Artificial Sequence
  Description of Artificial Sequence: Synthetic polypeptide
  CD8 SS-Myc-FKBP(F36V)-muEpoR(236-337;L264G,L265P)-muIL2Rb(337-539)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPASLLTASDLDPLILTLSLILVLISLGPTVLALLSHRRTLQQKIWPGIPSPESEFEGLFTTHKGNFQLWLLQRDGCLWWSPGSSFPEDPPAHLEVLSEPRAVQLLLLQKDSAPLPSPSGHSQASCFTNQGYFFFHLPNALEIESCQVYFTYDPCVEEEVEEDGSRLPEGSPHPPLLPLAGEQDDYCAFPPRDDLLLFSPSLSTPNTAYGGSRAPEERSPLSLHEGLPSLASRDLMGLQRPLERMPEGDGEGLSANSSGEQASVPEGNLHGQDQDRGQGPILTLNTDAYLSLQELQAQDSVHLI

SEQ ID NO: 13 - protein, 385 aa, Artificial Sequence
  Description of Artificial Sequence: Synthetic polypeptide
  CD8 SS-Myc-FKBP(F36V)-muEpoR(236-337;L264G,L265P)-muIL7R(316-459)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPASLLTASDLDPLILTLSLILVLISLGPTVLALLSHRRTLQQKIWPGIPSPESEFEGLFTTHKGNFQLWLLQRDGCLWWSPGSSFPEDPPAHLEVLSEPRARDEVESFLPNDLPAQPEELETQGHRAAVHSANRSPETSVSPPETVRRESPLRCLARNLSTCNAPPLLSSRSPDYRDGDRNRPPVYQDLLPNSGNTNVPVPVPQPLPFQSGILIPVSQRQPISTSSVLNQEEAYVTMSSFYQNK

SEQ ID NO: 14 - protein, 436 aa, Artificial Sequence
  Description of Artificial Sequence: Synthetic polypeptide
  CD8 SS-Myc-FKBP(F36V)-EpoR(237-338;L241G,L242P)-IL7R(316-459) -IL12Rb2 (775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 15 - protein, 426 aa, Artificial Sequence
  Description of Artificial Sequence: Synthetic polypeptide
  CD8 SS-Myc-FKBP(F36V)-GP130(609-700)-IL7R(316-459)-IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLETTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 16 - protein, 433 aa, Artificial Sequence
  Description of Artificial Sequence: Synthetic polypeptide
  CD8 SS-Myc-FKBP(F36V)-PrlR(221-319)-IL7R(316-459)-IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 17 - protein, 436 aa, Artificial Sequence
  Description of Artificial Sequence: Synthetic polypeptide
  CD8 SS-Myc-FKBP(F36V)-GHR(251-352)-IL7R(316-459)-IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLELPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 18 - protein, 431 aa, Artificial Sequence
  Description of Artificial Sequence: Synthetic polypeptide
  CD8 SS-Myc-FKBP(F36V)-GCSFR(614-710)-IL7R(316-459)-IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLELTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWEARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 19 - protein, 439 aa, Artificial Sequence
  Description of Artificial Sequence: Synthetic polypeptide
  CD8 SS-Myc-FKBP(F36V)-TPOR/MPLR(478-582)-IL7R(316-459) -IL12Rb2(775-825)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 20 - protein, 282 aa, Artificial Sequence
  Description of Artificial Sequence: Synthetic polypeptide
  CD8 SS-Myc-FKBP(F36V)- EpoR(237-338;L241G,L242P)-IL7R(376-416)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLP

SEQ ID NO: 21 - protein, 277 aa, Artificial Sequence
  Description of Artificial Sequence: Synthetic polypeptide
  CD8 SS-Myc-FKBP(F36V)- EpoR(237-338;L241G,L242P)-IL7R(424-459)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGILTLNPVAQGQPILTSLGSNQEEAYVTMSSFYQNQ

SEQ ID NO: 22 - protein, 309 aa, Artificial Sequence
  Description of Artificial Sequence: Synthetic polypeptide
  CD8 SS-Myc-FKBP(F36V)- EpoR(237-338;L241G,L242P) -IL7R(376-416,424-459)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLPQGQPILTSLGSNQEEAYVTMSSFYQNQ

SEQ ID NO: 23 - protein, 277 aa, Artificial Sequence
  Description of Artificial Sequence: Synthetic polypeptide
  CD8 SS-Myc-FKBP(F36V)- EpoR(237-338;L241G,L242P) -IL7R(424-459;Y456F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGILTLNPVAQGQPILTSLGSNQEEAYVTMSSFFQNQ

SEQ ID NO: 24 - protein, 309 aa, Artificial Sequence
  Description of Artificial Sequence: Synthetic polypeptide
  CD8 SS-Myc-FKBP(F36V)- EpoR(237-338;L241G,L242P) -IL7R(376-416,424-459;Y456F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLPQGQPILTSLGSNQEEAYVTMSSFFQNQ

SEQ ID NO: 25 - protein, 282 aa, Artificial Sequence
  Description of Artificial Sequence: Synthetic polypeptide
  CD8 SS-Myc-FKBP(F36V)- EpoR(237-338;L241G,L242P)-IL2Rb(393-433)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCDEGVAGAPTGSSPQPLQPLSGEDDAYCTFPSRDDLLLFSPS

SEQ ID NO: 26 - protein, 275 aa, Artificial Sequence
  Description of Artificial Sequence: Synthetic polypeptide
  CD8 SS-Myc-FKBP(F36V)- EpoR(237-338;L241G,L242P)-IL2Rb(518-551)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGQGEFRALNARLPLNTDAYLSLQELQGQDPTHLV

SEQ ID NO: 27 - protein, 323 aa, Artificial Sequence
  Description of Artificial Sequence: Synthetic polypeptide
  CD8 SS-Myc-FKBP(F36V)- EpoR(237-338;L241G,L242P) -IL2Rb(339-379,393-433)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQDEGVAGAPTGSSPQPLQPLSGEDDAYCTFPSRDDLLLFSPS

SEQ ID NO: 28 - protein, 316 aa, Artificial Sequence
  Description of Artificial Sequence: Synthetic polypeptide
  CD8 SS-Myc-FKBP(F36V)- EpoR(237-338;L241G,L242P) -IL2Rb(339-379,518-551)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQGQGEFRALNARLPLNTDAYLSLQELQGQDPTHLV

SEQ ID NO: 29 - protein, 316 aa, Artificial Sequence
  Description of Artificial Sequence: Synthetic polypeptide
  CD8 SS-Myc-FKBP(F36V)- EpoR(237-338;L241G,L242P) -IL2Rb(393-433,518-551)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCDEGVAGAPTGSSPQPLQPLSGEDDAYCTFPSRDDLLLFSPSGQGEFRALNARLPLNTDAYLSLQELQGQDPTHLV

SEQ ID NO: 30 - protein, 357 aa, Artificial Sequence
  Description of Artificial Sequence: Synthetic polypeptide
  CD8 SS-Myc-FKBP(F36V)- EpoR(237-338;L241G,L242P) -IL2Rb(339-379,393-433,518-551)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 31 - protein, 472 aa, Artificial Sequence
  Description of Artificial Sequence: Synthetic polypeptide
  CD8 SS-Myc-FKBP(F36V)- EpoR(237-338;L241G,L242P)-EGFR(955-1186)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 32 - protein, 459 aa, Artificial Sequence
  Description of Artificial Sequence: Synthetic polypeptide
  CD8 SS-Myc-FKBP(F36V)- EpoR(237-338;L241G,L242P) -EGFR(955-1044,1058-1186;Y974F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFFRALMDEEDMDDVVDADEYLIPQQGFFSSPSTSRTPLLSSLSATSNNSTVACIDRNGLQSCPIKEDSFLQRIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 33 - protein, 295 aa, Artificial Sequence
  Description of Artificial Sequence: Synthetic polypeptide
  CD8 SS-Myc-FKBP(F36V)- EpoR(237-338;L241G,L242P) -EGFR(955-1009;Y974F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFFRALMDEEDMDDVVDADEYLIPQQGFFSSPSTSRTP

SEQ ID NO: 34 - protein, 295 aa, Artificial Sequence
  Description of Artificial Sequence: Synthetic polypeptide
  CD8 SS-Myc-FKBP(F36V)- EpoR(237-338;L241G,L242P)-EGFR(1019-1085)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCNNSTVACIDRNGLQSCPIKEDSFLQRIDDTFLPVPEYINQSVPKRPAGSVQNPV

SEQ ID NO: 35 - protein, 295 aa, Artificial Sequence
  Description of Artificial Sequence: Synthetic polypeptide
  CD8 SS-Myc-FKBP(F36V)- EpoR(237-338;L241G,L242P) -EGFR(1037-1044,1058-1103;Y1068/1101F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCKEDSFLQRIDDTFLPVPEFINQSVPKRPAGSVQNPVYHNQPLNPAPSRDPHFQD

SEQ ID NO: 36 - protein, 295 aa, Artificial Sequence
  Description of Artificial Sequence: Synthetic polypeptide
  CD8 SS-Myc-FKBP(F36V)- EpoR(237-338;L241G,L242P) -EGFR(1066-1118;Y1068/1086F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVPEFINQSVPKRPAGSVQNPVFHNQPLNPAPSRDPHYQDPHSTAVGNPEYLNTV

SEQ ID NO: 37 - protein, 295 aa, Artificial Sequence
  Description of Artificial Sequence: Synthetic polypeptide
  CD8 SS-Myc-FKBP(F36V)- EpoR(237-338;L241G,L242P)-EGFR(1122-1165)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPEYLNTVQPTCVNSTFDSPAHWAQKGSHQISLDNPDYQQDFFPKEAKPNGIFKG

SEQ ID NO: 38 - protein, 295 aa, Artificial Sequence
  Description of Artificial Sequence: Synthetic polypeptide
  CD8 SS-Myc-FKBP(F36V)- EpoR(237-338;L241G,L242P) -EGFR(1133-1186;Y1148F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCWAQKGSHQISLDNPDFQQDFFPKEAKPNGIFKGSTAENAEYLRVAPQSSEFIGA

SEQ ID NO: 39 - protein, 397 aa, Artificial Sequence
  Description of Artificial Sequence: Synthetic polypeptide
  CD8 SS-Myc-FKBP(F36V)- EpoR(237-338;L241G,L242P)-BLNK(53-208)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 40 - protein, 397 aa, Artificial Sequence
  Description of Artificial Sequence: Synthetic polypeptide
  CD8 SS-Myc-FKBP(F36V)- EpoR(237-338;L241G,L242P)-BLNK(53-208;Y72F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDFENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 41 - protein, 397 aa, Artificial Sequence
  Description of Artificial Sequence: Synthetic polypeptide
  CD8 SS-Myc-FKBP(F36V)- EpoR(237-338;L241G,L242P) -BLNK(53-208;Y72F,Y96F)
MALPVTALLLPLALLLHAARPEQKLISEEDLMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDFENPDEHSDSEMYVMPAEENADDSFEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 42 - protein, 378 aa, Artificial Sequence
  Description of Artificial Sequence: Synthetic polypeptide
  CD8 SS-FKBP(F36V)- TPOR/MPLR(478-582)-IL7R(316-459)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 43 - protein, 453 aa, Artificial Sequence
  Description of Artificial Sequence: Synthetic polypeptide
  CD8 SS-FKBP(F36V)- TPOR/MPLR(478-582)-IL2Rb(333-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 44 - protein, 309 aa, Artificial Sequence
  Description of Artificial Sequence: Synthetic polypeptide
  CD8 SS-FKBP(F36V)- TPOR/MPLR(478-582)-IL2Rbsmall(393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLV

SEQ ID NO: 45 - protein, 350 aa, Artificial Sequence
  Description of Artificial Sequence: Synthetic polypeptide
  CD8 SS-FKBP(F36V)- TPOR/MPLR(478-582) -IL2Rbsmall(339-379,393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 46 - protein, 429 aa, Artificial Sequence
  Description of Artificial Sequence: Synthetic polypeptide
  CD8 SS-FKBP(F36V)- TPOR/MPLR(478-582)-IL7R(316-459) -IL12Rb2(775-825)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 47 - protein, 595 aa, Artificial Sequence
  Description of Artificial Sequence: Synthetic polypeptide
  CD8 SS-FKBP(F36V)- TPOR/MPLR(478-582)-IL7R(316-459)-IL21R(322-538)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 48 - protein, 595 aa, Artificial Sequence
  Description of Artificial Sequence: Synthetic polypeptide
  CD8 SS-FKBP(F36V)- TPOR/MPLR(478-582)- IL21R(322-538)-IL7R(316-459)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 49 - protein, 526 aa, Artificial Sequence
  Description of Artificial Sequence: Synthetic polypeptide
  CD8 SS-FKBP(F36V)- TPOR/MPLR(478-582)-IL2Rbsmall(393-433,518-551) -IL21R(322-538)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLVPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 50 - protein, 526 aa, Artificial Sequence
  Description of Artificial Sequence: Synthetic polypeptide
  CD8 SS-FKBP(F36V)- TPOR/MPLR(478-582)- IL21R(322-538) -IL2Rbsmall(393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASDEGVAGAPTGSSPQPLQPLSGEDDAYCTFPSRDDLLLFSPSGQGEFRALNARLPLNTDAYLSLQELQGQDPTHLV

SEQ ID NO: 51 - protein, 567 aa, Artificial Sequence
  Description of Artificial Sequence: Synthetic polypeptide
  CD8 SS-FKBP(F36V)- TPOR/MPLR(478-582)-IL2Rbsmall(339-379, 393-433,518-551)-IL21R(322-538)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLVPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 52 - protein, 567 aa, Artificial Sequence
  Description of Artificial Sequence: Synthetic polypeptide
  CD8 SS-FKBP(F36V)- TPOR/MPLR(478-582)- IL21R(322-538) -IL2Rbsmall(339-379,393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 53 - protein, 453 aa, Artificial Sequence
  Description of Artificial Sequence: Synthetic polypeptide
  CD8 SS-FKBP(F36V)- TPOR/MPLR(478-582)-IL2Rbsmall(393-433,518-551) -IL7R(316-459)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLVARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 54 - protein, 453 aa, Artificial Sequence
  Description of Artificial Sequence: Synthetic polypeptide
  CD8 SS-FKBP(F36V)- TPOR/MPLR(478-582)-IL7R(316-459) -IL2Rbsmall(393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQDEGVAGAPTGSSPQPLQPLSGEDDAYCTFPSRDDLLLFSPSGQGEFRALNARLPLNTDAYLSLQELQGQDPTHLV

SEQ ID NO: 55 - protein, 494 aa, Artificial Sequence
  Description of Artificial Sequence: Synthetic polypeptide
  CD8 SS-FKBP(F36V)- TPOR/MPLR(478-582)- IL2Rbsmall(339-379, 393-433,518-551)-IL7R(316-459)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLVARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 56 - protein, 494 aa, Artificial Sequence
  Description of Artificial Sequence: Synthetic polypeptide
  CD8 SS-FKBP(F36V)- TPOR/MPLR(478-582)-IL7R(316-459) -IL2Rbsmall(339-379,393-433,518-551)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 57 - protein, 429 aa, Artificial Sequence
  Description of Artificial Sequence: Synthetic polypeptide
  CD8 SS-FKBP(F36V)-PD1(156-191)-TPOR/MPLR (514-582)-IL7R(316-459) -IL12Rb2(775-825)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEPSPSPRPAGQFQTLVVGVVGGLLGSLVLLVWVLAVIRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 58 - protein, 288 aa, Artificial Sequence
  Description of Artificial Sequence: Synthetic polypeptide
  CD8 SS-FKBP(F36V)- TPOR/MPLR(478-582)-EGFR(1122-1165)
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPEYLNTVQPTCVNSTFDSPAHWAQKGSHQISLDNPDYQQDFFPKEAKPNGIFKG

SEQ ID NO: 59 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 60 - protein, 918 aa, Homo sapiens [sequence omitted]

SEQ ID NO: 61 - protein, 622 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 62 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 63 - protein, 863 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEELPGPRQGQWLGQTSEMSRALTPHPCVQDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 64 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 65 - protein, 21 aa, Artificial Sequence
  Description of Artificial Sequence: Synthetic peptide
  CD8 signal peptide
MALPVTALLLPLALLLHAARP

SEQ ID NO: 66 - protein, 14 aa, Artificial Sequence
  Description of Artificial Sequence: Synthetic peptide
  Myristoylation Motif
MGSSKSKPKDPSQR

SEQ ID NO: 67 - protein, 10 aa, Artificial Sequence
  Description of Artificial Sequence: Synthetic peptide
  Myc epitope tag
EQKLISEEDL

SEQ ID NO: 68 - protein, 11 aa, Artificial Sequence
  Description of Artificial Sequence: Synthetic peptide
  V5 epitope tag
IPNPLLGLDST

SEQ ID NO: 69 - protein, 108 aa, Artificial Sequence
  Description of Artificial Sequence: Synthetic polypeptide
  FKBP(F36V) dimerization domain
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 70 - protein, 214 aa, Artificial Sequence
  Description of Artificial Sequence: Synthetic polypeptide
  FKBP(F36V)-FKBP(F36V) dimerization domain
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 71 - protein, 107 aa, Artificial Sequence
  Description of Artificial Sequence: Synthetic polypeptide
  FKBP(F36V,L106P) dimerization domain
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKP

SEQ ID NO: 72 - protein, 213 aa, Artificial Sequence
  Description of Artificial Sequence: Synthetic polypeptide
  FKBP(F36V,L106P)-FKBP(F36V,L106P) dimerization domain
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPGVQVETISPGDGRTFPKRGQTCVVHYTGMLEDKKVDSSRDRNKPFKFMLGKQEVIRGWEEGVAQMSVGQRAKLTISPDYAYGATGHPGIIPPHATLVFDVELLKPE

SEQ ID NO: 73 - protein, 214 aa, Artificial Sequence
  Description of Artificial Sequence: Synthetic polypeptide
  FKBP(E31G,36V,R71G,K105E)-FKBP(E31G,36V,R71G,K105E) dimerization domain
MGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 74 - protein, 126 aa, Artificial Sequence
  Description of Artificial Sequence: Synthetic polypeptide
  ALK5/TGFBR1(1-126) dimerization domain
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVEL

SEQ ID NO: 75 - protein, 166 aa, Artificial Sequence
  Description of Artificial Sequence: Synthetic polypeptide
  TGFBR2(1-166) dimerization domain
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQ

SEQ ID NO: 76 - protein, 236 aa, Artificial Sequence
  Description of Artificial Sequence: Synthetic polypeptide
  EpoR(1-236) dimerization domain
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAW

SEQ ID NO: 77 - protein, 220 aa, Artificial Sequence
  Description of Artificial Sequence: Synthetic polypeptide
  PrlR(1-220) dimerization domain
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSP

SEQ ID NO: 78 - protein, 250 aa, Artificial Sequence
  Description of Artificial Sequence: Synthetic polypeptide
  GHR(1-250) dimerization domain
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVT

SEQ ID NO: 79 - protein, 477 aa, Artificial Sequence
  Description of Artificial Sequence: Synthetic polypeptide
  TPOR/MPLR(1-478) dimerization domain
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSW

SEQ ID NO: 80 - protein, 631 aa, Artificial Sequence
  Description of Artificial Sequence: Synthetic polypeptide
  EGFR(1-631) dimerization domain
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGP

SEQ ID NO: 81 - protein, 362 aa, Artificial Sequence
  Description of Artificial Sequence: Synthetic polypeptide
  FGFR1(1-362) dimerization domain
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEAL

SEQ ID NO: 82 - protein, 514 aa, Artificial Sequence
  Description of Artificial Sequence: Synthetic polypeptide
  PDGFRA(1-514) dimerization domain
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENREL

SEQ ID NO: 83 - protein, 518 aa, Artificial Sequence
  Description of Artificial Sequence: Synthetic polypeptide
  PDGFRB(1-518) dimerization domain
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDT

SEQ ID NO: 84 - protein, 54 aa, Artificial Sequence
  Description of Artificial Sequence: Synthetic polypeptide
  BCMA (1-54) dimerization domain
MLQMAGQCSQNEYFDSLLHACIPCQLRCSSNTPPLTCQRYCNASVTNSVKGTNA

SEQ ID NO: 85 - protein, 78 aa, Artificial Sequence
  Description of Artificial Sequence: Synthetic polypeptide
  BAFF-R (1-78) dimerization domain
MRRGPRSLRGRDAPAPTPCVPAECFDLLVRHCVACGLLRTPRPKPAGASSPAPRTALQPQESVGAGAGEAALPLPGLL

SEQ ID NO: 86 - protein, 165 aa, Artificial Sequence
  Description of Artificial Sequence: Synthetic polypeptide
  TACI (1-165) dimerization domain
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYS

SEQ ID NO: 87 - protein, 214 aa, Artificial Sequence
  Description of Artificial Sequence: Synthetic polypeptide
  OX40 (1-214) dimerization domain
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRA

SEQ ID NO: 88 - protein, 69 aa, Artificial Sequence
  Description of Artificial Sequence: Synthetic polypeptide
  CD8(138-206) tyrosine kinase activating domain
TTTPAPRPPTPAPTIASQPLSLRPEACRPAAGGAVHTRGLDFACDIYIWAPLAGTCGVLLLSLVITLYC

SEQ ID NO: 89 - protein, 102 aa, Artificial Sequence
  Description of Artificial Sequence: Synthetic polypeptide
  EpoR(237-338;L241G,L242P) tyrosine kinase activating domain
SEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERC

SEQ ID NO: 90 - protein, 102 aa, Artificial Sequence
  Description of Artificial Sequence: Synthetic polypeptide
  EpoR(237-338) tyrosine kinase activating domain
SEPVSGPTPSDLDPLILTLSLILVVILVLLTVLALLSHRRALKQKIWPGIPSPESEFEGLFTTHKGNFQLWLYQNDGCLWWSPCTPFTEDPPASLEVLSERC

SEQ ID NO: 91 - protein, 46 aa, Artificial Sequence
  Description of Artificial Sequence: Synthetic polypeptide
  EpoR(237-282;L241G,L242P) tyrosine kinase activating domain
SEPVSGPTPSDLDPLILTLSLILVVILVGPTVLALLSHRRALKQKI

SEQ ID NO: 92 - protein, 92 aa, Artificial Sequence
  Description of Artificial Sequence: Synthetic polypeptide
  GP130(609-700) tyrosine kinase activating domain
TTPKFAQGEIEAIVVPVCLAFLLTTLLGVLFCFNKRDLIKKHIWPNVPDPSKSHIAQWSPHTPPRHNFNSKDQMYSDGNFTDVSVVEIEAND

SEQ ID NO: 93 - protein, 99 aa, Artificial Sequence
  Description of Artificial Sequence: Synthetic polypeptide
  PrlR(221-319) tyrosine kinase activating domain
ATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDD

SEQ ID NO: 94 - protein, 102 aa, Artificial Sequence
  Description of Artificial Sequence: Synthetic polypeptide
  GHR(251-352) tyrosine kinase activating domain
LPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDE

SEQ ID NO: 95 - protein, 97 aa, Artificial Sequence
  Description of Artificial Sequence: Synthetic polypeptide
  GCSFR(614-710) tyrosine kinase activating domain
LTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWE

SEQ ID NO: 96 - protein, 105 aa, Artificial Sequence
  Description of Artificial Sequence: Synthetic polypeptide
  TPOR/MPLR(478-582) tyrosine kinase activating domain
SDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 97 - protein, 51 aa, Artificial Sequence
  Description of Artificial Sequence: Synthetic polypeptide
  TPOR/MPLR(478-528) tyrosine kinase activating domain
SDPTRVETATETAWISLVTALHLVLGLSAVLGLLLLRWQFPAHYRRLRHAL

SEQ ID NO: 98 - protein, 348 aa, Artificial Sequence
  Description of Artificial Sequence: Synthetic polypeptide
  EGFR(632-979) tyrosine kinase activating domain
GLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYL

SEQ ID NO: 99 - protein, 405 aa, Artificial Sequence
  Description of Artificial Sequence: Synthetic polypeptide
  FGFR1(363-767) tyrosine kinase activating domain
EERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYL

SEQ ID NO: 100 - protein, 440 aa, Artificial Sequence
  Description of Artificial Sequence: Synthetic polypeptide
  PDGFRA(515-954) tyrosine kinase activating domain
KLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLL

SEQ ID NO: 101 - protein, 444 aa, Artificial Sequence
  Description of Artificial Sequence: Synthetic polypeptide
  PDGFRB(519-962) tyrosine kinase activating domain
QEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLL

SEQ ID NO: 102 - protein, 102 aa, Artificial Sequence
  Description of Artificial Sequence: Synthetic polypeptide
  murine EpoR(236-337;L264G,L265P) tyrosine kinase activating domain
SEPASLLTASDLDPLILTLSLILVLISLGPTVLALLSHRRTLQQKIWPGIPSPESEFEGLFTTHKGNFQLWLLQRDGCLWWSPGSSFPEDPPAHLEVLSEPR

SEQ ID NO: 103 - protein, 236 aa, Artificial Sequence
  Description of Artificial Sequence: Synthetic polypeptide
  EpoR(273-508) tyrosine kinase activating domain
SHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 104 - protein, 105 aa, Artificial Sequence
  Description of Artificial Sequence: Synthetic polypeptide
  PD1(156-191)-TPOR/MPLR (514-582) TpoR tyrosine kinase activating domain with transmembrane domain variant
PSPSPRPAGQFQTLVVGVVGGLLGSLVLLVWVLAVIRWQFPAHYRRLRHALWPSLPDLHRVLGQYLRDTAALSPPKATVSDTCEEVEPSLLEILPKSSERTPLPL

SEQ ID NO: 105 - protein, 105 aa, Artificial Sequence; identical to SEQ ID NO: 96
  Description of Artificial Sequence: Synthetic polypeptide
  TPOR/MPLR(478-582) (wildtype sequence) TpoR tyrosine kinase activating domain with transmembrane domain variant

SEQ ID NO: 106 - protein, 104 aa, Artificial Sequence
  Description of Artificial Sequence: Synthetic polypeptide
  TPOR/MPLR(N-1) TpoR tyrosine kinase activating domain with transmembrane domain variant
SDPTRVETATETWISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 107 - protein, 103 aa, Artificial Sequence
  Description of Artificial Sequence: Synthetic polypeptide
  TPOR/MPLR(N-2) TpoR tyrosine kinase activating domain with transmembrane domain variant
SDPTRVETATETISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 108 - protein, 104 aa, Artificial Sequence
  Description of Artificial Sequence: Synthetic polypeptide
  TPOR/MPLR(N-2+1) TpoR tyrosine kinase activating domain with transmembrane domain variant
SDPTRVETATETLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 109 - protein, 102 aa, Artificial Sequence
  Description of Artificial Sequence: Synthetic polypeptide
  TPOR/MPLR(N-3) TpoR tyrosine kinase activating domain with transmembrane domain variant
SDPTRVETATETSLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 110 - protein, 101 aa, Artificial Sequence
  Description of Artificial Sequence: Synthetic polypeptide
  TPOR/MPLR(N-4) TpoR tyrosine kinase activating domain with transmembrane domain variant
SDPTRVETATETLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 111 - protein, 102 aa, Artificial Sequence
  Description of Artificial Sequence: Synthetic polypeptide
  TPOR/MPLR(N-4+1) TpoR tyrosine kinase activating domain with transmembrane domain variant
SDPTRVETATETILVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 112 - protein, 100 aa, Artificial Sequence
  Description of Artificial Sequence: Synthetic polypeptide
  TPOR/MPLR(N-5) TpoR tyrosine kinase activating domain with transmembrane domain variant
SDPTRVETATETVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 113 - protein, 99 aa, Artificial Sequence
  Description of Artificial Sequence: Synthetic polypeptide
  TPOR/MPLR(N-6) TpoR tyrosine kinase activating domain with transmembrane domain variant
SDPTRVETATETTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 114 - protein, 98 aa, Artificial Sequence
  Description of Artificial Sequence: Synthetic polypeptide
  TPOR/MPLR(N-7) TpoR tyrosine kinase activating domain with transmembrane domain variant
SDPTRVETATETALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 115 - protein, 97 aa, Artificial Sequence
  Description of Artificial Sequence: Synthetic polypeptide
  TPOR/MPLR(N-8) TpoR tyrosine kinase activating domain with transmembrane domain variant
SDPTRVETATETLHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 116 - protein, 96 aa, Artificial Sequence
  Description of Artificial Sequence: Synthetic polypeptide
  TPOR/MPLR(N-9) TpoR tyrosine kinase activating domain with transmembrane domain variant
SDPTRVETATETHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 117 - protein, 95 aa, Artificial Sequence
  Description of Artificial Sequence: Synthetic polypeptide
  TPOR/MPLR(N-10) TpoR tyrosine kinase activating domain with transmembrane domain variant
SDPTRVETATETLVLGLSAVLGLLLLRWQFPAHYRRLRHALWPSLPDLHRVLGQYLRDTAALSPPKATVSDTCEEVEPSLLEILPKSSERTPLPL

SEQ ID NO: 118 - protein, 94 aa, Artificial Sequence
  Description of Artificial Sequence: Synthetic polypeptide
  TPOR/MPLR(N-11) TpoR tyrosine kinase activating domain with transmembrane domain variant
SDPTRVETATETVLGLSAVLGLLLLRWQFPAHYRRLRHALWPSLPDLHRVLGQYLRDTAALSPPKATVSDTCEEVEPSLLEILPKSSERTPLPL

SEQ ID NO: 119 - protein, 93 aa, Artificial Sequence
  Description of Artificial Sequence: Synthetic polypeptide
  TPOR/MPLR(N-12) TpoR tyrosine kinase activating domain with transmembrane domain variant
SDPTRVETATETLGLSAVLGLLLLRWQFPAHYRRLRHALWPSLPDLHRVLGQYLRDTAALSPPKATVSDTCEEVEPSLLEILPKSSERTPLPL

SEQ ID NO: 120 - protein, 92 aa, Artificial Sequence
  Description of Artificial Sequence: Synthetic polypeptide
  TPOR/MPLR(N-13) TpoR tyrosine kinase activating domain with transmembrane domain variant
SDPTRVETATETGLSAVLGLLLLRWQFPAHYRRLRHALWPSLPDLHRVLGQYLRDTAALSPPKATVSDTCEEVEPSLLEILPKSSERTPLPL

SEQ ID NO: 121 - protein, 91 aa, Artificial Sequence
  Description of Artificial Sequence: Synthetic polypeptide
  TPOR/MPLR(N-14) TpoR tyrosine kinase activating domain with transmembrane domain variant
SDPTRVETATETLSAVLGLLLLRWQFPAHYRRLRHALWPSLPDLHRVLGQYLRDTAALSPPKATVSDTCEEVEPSLLEILPKSSERTPLPL

SEQ ID NO: 122 - protein, 90 aa, Artificial Sequence
  Description of Artificial Sequence: Synthetic polypeptide
  TPOR/MPLR(N-15) TpoR tyrosine kinase activating domain with transmembrane domain variant
SDPTRVETATETSAVLGLLLLRWQFPAHYRRLRHALWPSLPDLHRVLGQYLRDTAALSPPKATVSDTCEEVEPSLLEILPKSSERTPLPL

SEQ ID NO: 123 - protein, 89 aa, Artificial Sequence
  Description of Artificial Sequence: Synthetic polypeptide
  TPOR/MPLR(N-16) TpoR tyrosine kinase activating domain with transmembrane domain variant
SDPTRVETATETAVLGLLLLRWQFPAHYRRLRHALWPSLPDLHRVLGQYLRDTAALSPPKATVSDTCEEVEPSLLEILPKSSERTPLPL

SEQ ID NO: 124 - protein, 88 aa, Artificial Sequence
  Description of Artificial Sequence: Synthetic polypeptide
  TPOR/MPLR(N-17) TpoR tyrosine kinase activating domain with transmembrane domain variant
SDPTRVETATETVLGLLLLRWQFPAHYRRLRHALWPSLPDLHRVLGQYLRDTAALSPPKATVSDTCEEVEPSLLEILPKSSERTPLPL

SEQ ID NO: 125 - protein, 87 aa, Artificial Sequence
  Description of Artificial Sequence: Synthetic polypeptide
  TPOR/MPLR(N-18) TpoR tyrosine kinase activating domain with transmembrane domain variant
SDPTRVETATETLGLLLLRWQFPAHYRRLRHALWPSLPDLHRVLGQYLRDTAALSPPKATVSDTCEEVEPSLLEILPKSSERTPLPL

SEQ ID NO: 126 - protein, 106 aa, Artificial Sequence
  Description of Artificial Sequence: Synthetic polypeptide
  TPOR/MPLR(N+1) TpoR tyrosine kinase activating domain with transmembrane domain variant
SDPTRVETATETAWLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 127 - protein, 107 aa, Artificial Sequence
  Description of Artificial Sequence: Synthetic polypeptide
  TPOR/MPLR(N+2) TpoR tyrosine kinase activating domain with transmembrane domain variant
SDPTRVETATETAWVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 128 - protein, 108 aa, Artificial Sequence
  Description of Artificial Sequence: Synthetic polypeptide
  TPOR/MPLR(N+3) TpoR tyrosine kinase activating domain with transmembrane domain variant
SDPTRVETATETAWLVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 129 - protein, 109 aa, Artificial Sequence
  Description of Artificial Sequence: Synthetic polypeptide
  TPOR/MPLR(N+4) TpoR tyrosine kinase activating domain with transmembrane domain variant
SDPTRVETATETAWILVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 130 - protein, 110 aa, Artificial Sequence
  Description of Artificial Sequence: Synthetic polypeptide
  TPOR/MPLR(N+5) TpoR tyrosine kinase activating domain with transmembrane domain variant
SDPTRVETATETAWLILVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 131 - protein, 111 aa, Artificial Sequence
  Description of Artificial Sequence: Synthetic polypeptide
  TPOR/MPLR(N+6) TpoR tyrosine kinase activating domain with transmembrane domain variant
SDPTRVETATETAWLLILVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 132 - protein, 112 aa, Artificial Sequence
  Description of Artificial Sequence: Synthetic polypeptide
  TPOR/MPLR(N+7) TpoR tyrosine kinase activating domain with transmembrane domain variant
SDPTRVETATETAWVLLILVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 133 - protein, 113 aa, Artificial Sequence
  Description of Artificial Sequence: Synthetic polypeptide
  TPOR/MPLR(N+8) TpoR tyrosine kinase activating domain with transmembrane domain variant
SDPTRVETATETAWLVLLILVLISLVTALHLVLGLSAVLGLLLLRWQFPAHYRRLRHALWPSLPDLHRVLGQYLRDTAALSPPKATVSDTCEEVEPSLLEILPKSSERTPLPL

SEQ ID NO: 134 - protein, 144 aa, Artificial Sequence
  Description of Artificial Sequence: Synthetic polypeptide
  IL7R(316-459) tyrosine kinase effector domains
ARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 135 - protein, 219 aa, Artificial Sequence
  Description of Artificial Sequence: Synthetic polypeptide
  IL2Rb(333-551) tyrosine kinase effector domains
VTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 136 - protein, 50 aa, Artificial Sequence
  Description of Artificial Sequence: Synthetic polypeptide
  IFNAR1(508-557) tyrosine kinase effector domains
ISTIATVEETNQTDEDHKKYSSQTSQDSGNYSNEDESESKTSEELQQDFV

SEQ ID NO: 137 - protein, 206 aa, Artificial Sequence
  Description of Artificial Sequence: Synthetic polypeptide
  IFNAR2(310-515) tyrosine kinase effector domains
KKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 138 - protein, 256 aa, Artificial Sequence
  Description of Artificial Sequence: Synthetic polypeptide
  IFNAR1/2(IFNAR1 residues 508-557-IFNAR2 residues 310-515) tyrosine kinase effector domains
ISTIATVEETNQTDEDHKKYSSQTSQDSGNYSNEDESESKTSEELQQDFVKKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 139 - protein, 221 aa, Artificial Sequence
  Description of Artificial Sequence: Synthetic polypeptide
  IFNLR1(300-520) tyrosine kinase effector domains
RGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 140 - protein, 35 aa, Artificial Sequence
  Description of Artificial Sequence: Synthetic polypeptide
  Common Gamma Chain(335-369) tyrosine kinase effector domains
IPPKGGALGEGPGASPCNQHSPYWAPPCYTLKPET

SEQ ID NO: 141 - protein, 166 aa, Artificial Sequence
  Description of Artificial Sequence: Synthetic polypeptide
  IL9R(356-521) tyrosine kinase effector domains
TALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 142 - protein, 217 aa, Artificial Sequence
  Description of Artificial Sequence: Synthetic polypeptide
  IL21R(322-538) tyrosine kinase effector domains
PRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 143 - protein, 286 aa, Artificial Sequence
  Description of Artificial Sequence: Synthetic polypeptide
  GHR(353-638) tyrosine kinase effector domains
PDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 144 - protein, 170 aa, Artificial Sequence
  Description of Artificial Sequence: Synthetic polypeptide
  EpoR(339-508) tyrosine kinase effector domains
WGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 145 - protein, 203 aa, Artificial Sequence
  Description of Artificial Sequence: Synthetic polypeptide
  murine IL2Rb(337-539) tyrosine kinase effector domains
AVQLLLLQKDSAPLPSPSGHSQASCFTNQGYFFFHLPNALEIESCQVYFTYDPCVEEEVEEDGSRLPEGSPHPPLLPLAGEQDDYCAFPPRDDLLLFSPSLSTPNTAYGGSRAPEERSPLSLHEGLPSLASRDLMGLQRPLERMPEGDGEGLSANSSGEQASVPEGNLHGQDQDRGQGPILTLNTDAYLSLQELQAQDSVHLI

SEQ ID NO: 146 - protein, 144 aa, Artificial Sequence
  Description of Artificial Sequence: Synthetic polypeptide
  murine IL7Ra(316-459) tyrosine kinase effector domains
ARDEVESFLPNDLPAQPEELETQGHRAAVHSANRSPETSVSPPETVRRESPLRCLARNLSTCNAPPLLSSRSPDYRDGDRNRPPVYQDLLPNSGNTNVPVPVPQPLPFQSGILIPVSQRQPISTSSVLNQEEAYVTMSSFYQNK

SEQ ID NO: 147 - protein, 231 aa, Artificial Sequence
  Description of Artificial Sequence: Synthetic polypeptide
  EGFR(955-1186) tyrosine kinase effector domains
VIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 148 - protein, 218 aa, Artificial Sequence
  Description of Artificial Sequence: Synthetic polypeptide
  EGFR(955-1186;Y974F,d1045-1057) tyrosine kinase effector domains
VIQGDERMHLPSPTDSNFFRALMDEEDMDDVVDADEYLIPQQGFFSSPSTSRTPLLSSLSATSNNSTVACIDRNGLQSCPIKEDSFLQRIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 149 - protein, 54 aa, Artificial Sequence
  Description of Artificial Sequence: Synthetic polypeptide
  EGFR(955-1009;Y974F) tyrosine kinase effector domains
VIQGDERMHLPSPTDSNFFRALMDEEDMDDVVDADEYLIPQQGFFSSPSTSRTP

SEQ ID NO: 150 - protein, 54 aa, Artificial Sequence
  Description of Artificial Sequence: Synthetic polypeptide
  EGFR(1019-1085) tyrosine kinase effector domains
NNSTVACIDRNGLQSCPIKEDSFLQRIDDTFLPVPEYINQSVPKRPAGSVQNPV

SEQ ID NO: 151 - protein, 54 aa, Artificial Sequence
  Description of Artificial Sequence: Synthetic polypeptide
  EGFR(1037-1103;Y1068/1101F,d1045-1057) tyrosine kinase effector domains
KEDSFLQRIDDTFLPVPEFINQSVPKRPAGSVQNPVYHNQPLNPAPSRDPHFQD

SEQ ID NO: 152 - protein, 54 aa, Artificial Sequence
  Description of Artificial Sequence: Synthetic polypeptide
  EGFR(1066-1118;Y1068/1086F) tyrosine kinase effector domains
VPEFINQSVPKRPAGSVQNPVFHNQPLNPAPSRDPHYQDPHSTAVGNPEYLNTV

SEQ ID NO: 153 - protein, 54 aa, Artificial Sequence
  Description of Artificial Sequence: Synthetic polypeptide
  EGFR(1122-1165) tyrosine kinase effector domains
PEYLNTVQPTCVNSTFDSPAHWAQKGSHQISLDNPDYQQDFFPKEAKPNGIFKG

SEQ ID NO: 154 - protein, 54 aa, Artificial Sequence
  Description of Artificial Sequence: Synthetic polypeptide
  EGFR(1133-1186;Y1148F) tyrosine kinase effector domains
WAQKGSHQISLDNPDFQQDFFPKEAKPNGIFKGSTAENAEYLRVAPQSSEFIGA

SEQ ID NO: 155 - protein, 51 aa, Artificial Sequence
  Description of Artificial Sequence: Synthetic polypeptide
  IL12Rb2(775-825) tyrosine kinase effector domains
SDPKPENPACPWTVLPAGDLPTHDGYLPSNIDDLPSHEAPLADSLEELEPQ

SEQ ID NO: 156 - protein, 41 aa, Artificial Sequence
  Description of Artificial Sequence: Synthetic polypeptide
  IL7R(376-416) tyrosine kinase effector domains
ACDAPILSSSRSLDCRESGKNGPHVYQDLLLSLGTTNSTLP

SEQ ID NO: 157 - protein, 36 aa, Artificial Sequence
  Description of Artificial Sequence: Synthetic polypeptide
  IL7R(424-459) tyrosine kinase effector domains
GILTLNPVAQGQPILTSLGSNQEEAYVTMSSFYQNQ

SEQ ID NO: 158 - protein, 68 aa, Artificial Sequence
  Description of Artificial Sequence: Synthetic polypeptide
  IL7R(376-416,424-459) tyrosine kinase effector domains
ACDAPILSSSRSLDCRESGKNGPHVYQDLLLSLGTTNSTLPQGQPILTSLGSNQEEAYVTMSSFYQNQ

SEQ ID NO: 159 - protein, 36 aa, Artificial Sequence
  Description of Artificial Sequence: Synthetic polypeptide
  IL7R(424-459;Y456F) tyrosine kinase effector domains
GILTLNPVAQGQPILTSLGSNQEEAYVTMSSFFQNQ

SEQ ID NO: 160 - protein, 68 aa, Artificial Sequence
  Description of Artificial Sequence: Synthetic polypeptide
  IL7R(376-416,424-459,Y456F) tyrosine kinase effector domains
ACDAPILSSSRSLDCRESGKNGPHVYQDLLLSLGTTNSTLPQGQPILTSLGSNQEEAYVTMSSFFQNQ

SEQ ID NO: 161 - protein, 75 aa, Artificial Sequence
  Description of Artificial Sequence: Synthetic polypeptide
  IL2small(393-433) tyrosine kinase effector domains
DEGVAGAPTGSSPQPLQPLSGEDDAYCTFPSRDDLLLFSPSGQGEFRALNARLPLNTDAYLSLQELQGQDPTHLV

SEQ ID NO: 162 - protein, 34 aa, Artificial Sequence
  Description of Artificial Sequence: Synthetic polypeptide
  IL2small(518-551) tyrosine kinase effector domains
GQGEFRALNARLPLNTDAYLSLQELQGQDPTHLV

SEQ ID NO: 163 - protein, 82 aa, Artificial Sequence
  Description of Artificial Sequence: Synthetic polypeptide
  IL2small(339-379,393-433) tyrosine kinase effector domains
QQDKVPEPASLSSNHSLTSCFTNQGYFFFHLPDALEIEACQDEGVAGAPTGSSPQPLQPLSGEDDAYCTFPSRDDLLLFSPS

SEQ ID NO: 164 - protein, 75 aa, Artificial Sequence
  Description of Artificial Sequence: Synthetic polypeptide
  IL2small(339-379,518-551) tyrosine kinase effector domains
QQDKVPEPASLSSNHSLTSCFTNQGYFFFHLPDALEIEACQGQGEFRALNARLPLNTDAYLSLQELQGQDPTHLV

SEQ ID NO: 165 - protein, 75 aa, Artificial Sequence; identical to SEQ ID NO: 161
  Description of Artificial Sequence: Synthetic polypeptide
  IL2small(393-433,518-551) tyrosine kinase effector domains

SEQ ID NO: 166 - protein, 116 aa, Artificial Sequence
  Description of Artificial Sequence: Synthetic polypeptide
  IL2small(339-379,393-433,518-551) tyrosine kinase effector domains
QQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 167 - protein, 43 aa, Artificial Sequence
  Description of Artificial Sequence: Synthetic polypeptide
  IFNAR2small(310-352) tyrosine kinase effector domains
KKKVWDYNYDDESDSDTEAAPRTSGGGYTMHGLTVRPLGQASA

SEQ ID NO: 168 - protein, 29 aa, Artificial Sequence
  Description of Artificial Sequence: Synthetic peptide
  IFNAR2small(486-515) tyrosine kinase effector domains
EGLWSEDAPSDQSDTSESDVDLGDGYIMR

SEQ ID NO: 169 - protein, 72 aa, Artificial Sequence
  Description of Artificial Sequence: Synthetic polypeptide
  IFNAR2small(310-352,486-515) tyrosine kinase effector domains
KKKVWDYNYDDESDSDTEAAPRTSGGGYTMHGLTVRPLGQASAEGLWSEDAPSDQSDTSESDVDLGDGYIMR

SEQ ID NO: 170 - protein, 156 aa, Artificial Sequence
  Description of Artificial Sequence: Synthetic polypeptide
  BLNK(53-208) tyrosine kinase effector domains
ASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 171 - protein, 156 aa, Artificial Sequence
  Description of Artificial Sequence: Synthetic polypeptide
  BLNK(53-208;Y72F) tyrosine kinase effector domains
ASESPADEEEQWSDDFDSDFENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 172 - protein, 156 aa, Artificial Sequence
  Description of Artificial Sequence: Synthetic polypeptide
  BLNK(53-208;Y72F,Y96F) tyrosine kinase effector domains
ASESPADEEEQWSDDFDSDFENPDEHSDSEMYVMPAEENADDSFEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 173 - protein, 170 aa, Artificial Sequence; identical to SEQ ID NO: 144
  Description of Artificial Sequence: Synthetic polypeptide
  EpoR(339-508) tyrosine kinase effector domains

SEQ ID NO: 174 - protein, 149 aa, Artificial Sequence
  Description of Artificial Sequence: Synthetic polypeptide
  IL12Rb2(714-862) tyrosine kinase effector domains
VTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 175 - protein, 40 aa, Artificial Sequence
  Description of Artificial Sequence: Synthetic polypeptide
  IL12Rb1(622-662) tyrosine kinase effector domains
WDKGERTEPLEKTELPEGAPELALDTELSLEDGDRCKAKM

SEQ ID NO: 176 - protein, 275 aa, Artificial Sequence
  Description of Artificial Sequence: Synthetic polypeptide
  IL10R1(304-578) tyrosine kinase effector domains
VSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 177 - protein, 461 aa, Artificial Sequence
  Description of Artificial Sequence: Synthetic polypeptide
  Myristoyl-Myd88-CD40-FKBP(F36V)x2 (GoCART) construct
MGSSKSKPKDPSQRMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIKKVAKKPTNKAPHPKQEPQEINFPDDLPGSNTAAPVQETLHGCQPVTQEDGKESRISVQERQGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 178 - protein, 233 aa, Artificial Sequence
  Description of Artificial Sequence: Synthetic polypeptide
  TagBFP construct
MSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 179 - protein, 13 aa, Artificial Sequence
  Description of Artificial Sequence: Synthetic peptide
  V5 epitope tag
KPIPNPLLGLDST

SEQ ID NO: 180 - protein, 246 aa, Artificial Sequence
  Description of Artificial Sequence: Synthetic polypeptide
  2173 scFv domain
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 181 - protein, 241 aa, Artificial Sequence
  Description of Artificial Sequence: Synthetic polypeptide
  26C8 scFv domain
QVQLQESGPGLVKPSETLSLTCTVSDNSISNYYWSWIRQPPGKGLEWIAYIYYSGTTNYNPSLKSRVTISLDTSKNQFSLQLSSVTAADAAVYYCARVFHWGFAFDIWGQGTMVTVSSGGGGSGGGGSGGGGSEIVLTQSPGTLSLSPGERATLSCRASQRVSNTYLAWYQQNPGQAPRLLIYGASSRATGIPDRFSGSGSGTDFTLTISRLEPEDFAVYYCQQYGTSPLTFGGGTKVEIK

SEQ ID NO: 182 - protein, 69 aa, Artificial Sequence; identical to SEQ ID NO: 88
  Description of Artificial Sequence: Synthetic polypeptide
  CD8 hinge and transmembrane domain

SEQ ID NO: 183 - protein, 42 aa, Artificial Sequence
  Description of Artificial Sequence: Synthetic polypeptide
  4-1BB intracellular signaling domain
KRGRKKLLYIFKQPFMRPVQTTQEEDGCSCRFPEEEEGGCEL

SEQ ID NO: 184 - protein, 112 aa, Artificial Sequence
  Description of Artificial Sequence: Synthetic polypeptide
  CD3z intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 185 - protein, 233 aa, Artificial Sequence; identical to SEQ ID NO: 178
  Description of Artificial Sequence: Synthetic polypeptide
  BFP domain

SEQ ID NO: 186 - protein, 22 aa, Artificial Sequence
  Description of Artificial Sequence: Synthetic peptide
  P2A domain
GSGATNFSLLKQAGDVEENPGP

SEQ ID NO: 187 - protein, 429 aa, Artificial Sequence; identical to SEQ ID NO: 46
  Description of Artificial Sequence: Synthetic polypeptide

SEQ ID NO: 188 - protein, 428 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 189 - protein, 427 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 190 - protein, 428 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 191 - protein, 426 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETSLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 192 - protein, 425 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 193 - protein, 426 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETILVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 194 - protein, 424 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 195 - protein, 423 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 196 - protein, 422 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 197 - protein, 421 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 198 - protein, 420 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 199 - protein, 419 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 200 - protein, 418 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 201 - protein, 417 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 202 - protein, 416 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 203 - protein, 415 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 204 - protein, 414 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 205 - protein, 413 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 206 - protein, 412 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 207 - protein, 411 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 208 - protein, 430 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 209 - protein, 431 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 210 - protein, 432 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 211 - protein, 433 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 212 - protein, 434 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 213 - protein, 435 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 214 - protein, 436 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWVLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 215 - protein, 437 aa, Artificial Sequence
  Description of Artificial Sequence: Synthetic polypeptide
MALPVTALLLPLALLLHAARPMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLVLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 216 - protein, 53 aa, Artificial Sequence
  Description of Artificial Sequence: Synthetic polypeptide
  dimerization domain
MLQMAGQCSQNEYFDSLLHACIPCQLRCSSNTPPLTCQRYCNASVTNSVKGTN

SEQ ID NO: 217 - protein, 170 aa, Artificial Sequence
  Description of Artificial Sequence: Synthetic polypeptide
  dimerization domain
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 218 - protein, 108 aa, Artificial Sequence
  Description of Artificial Sequence: Synthetic polypeptide
  dimerization domain
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLES

SEQ ID NO: 219 - protein, 102 aa, Artificial Sequence; identical to SEQ ID NO: 90
  Description of Artificial Sequence: Synthetic polypeptide
  exemplary tyrosine kinase activating domain

SEQ ID NO: 220 - protein, 348 aa, Artificial Sequence; identical to SEQ ID NO: 98
  Description of Artificial Sequence: Synthetic polypeptide
  exemplary tyrosine kinase activating domain

SEQ ID NO: 221 - protein, 219 aa, Artificial Sequence; identical to SEQ ID NO: 135
  Description of Artificial Sequence: Synthetic polypeptide
  exemplary tyrosine effector domain

SEQ ID NO: 222 - protein, 231 aa, Artificial Sequence; identical to SEQ ID NO: 147
  Description of Artificial Sequence: Synthetic polypeptide
  exemplary tyrosine effector domain

SEQ ID NO: 223 - protein, 156 aa, Artificial Sequence; identical to SEQ ID NO: 170
  Description of Artificial Sequence: Synthetic polypeptide
  exemplary tyrosine effector domain

SEQ ID NO: 224 - protein, 15 aa, Artificial Sequence
  Description of Artificial Sequence: Synthetic peptide
  peptide linker
GGGGSGGGGSGGGGS

SEQ ID NO: 225 - protein, 380 aa, Artificial Sequence
  Description of Artificial Sequence: Synthetic polypeptide
  FKBP(F36V)-EpoR(237-508;L241G,L242P)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 226 - protein, 450 aa, Artificial Sequence
  Description of Artificial Sequence: Synthetic polypeptide <220; EpoR(273-508)-FKBP(F36V)-FKBP(F36V)
SHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 227 - protein, 450 aa, Artificial Sequence
  Description of Artificial Sequence: Synthetic polypeptide <220; EpoR(273-508)-FKBP(E31G,36V,R71G,K105E)-FKBP(E31G,36V,R71G,K105E)
SHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACSMGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 228 - protein, 496 aa, Artificial Sequence
  Description of Artificial Sequence: Synthetic polypeptide <220; FKBP(F36V)-EpoR(237-338;L241G,L242P)-GHR(353-638)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 229 - protein, 429 aa, Artificial Sequence
  Description of Artificial Sequence: Synthetic polypeptide <220; FKBP(F36V)-EpoR(237-338;L241G,L242P)-IL2Rb(333-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 230 - protein, 354 aa, Artificial Sequence
  Description of Artificial Sequence: Synthetic polypeptide <220; FKBP(F36V)-EpoR(237-338;L241G,L242P)-IL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 231 - protein, 359 aa, Artificial Sequence
  Description of Artificial Sequence: Synthetic polypeptide <220; FKBP(F36V)-EpoR(237-338;L241G,L242P)-IL12Rb2(714-862)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 232 - protein, 261 aa, Artificial Sequence
  Description of Artificial Sequence: Synthetic polypeptide <220; FKBP(F36V)-EpoR(237-338;L241G,L242P)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCSDPKPENPACPWTVLPAGDLPTHDGYLPSNIDDLPSHEAPLADSLEELEPQ

SEQ ID NO: 233 - protein, 427 aa, Artificial Sequence
  Description of Artificial Sequence: Synthetic polypeptide <220; FKBP(F36V)-EpoR(237-338;L241G,L242P)-IL21R(322-538)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 234 - protein, 416 aa, Artificial Sequence
  Description of Artificial Sequence: Synthetic polypeptide <220; FKBP(F36V)-EpoR(237-338;L241G,L242P)-IFNAR2(310-515)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCKKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 235 - protein, 431 aa, Artificial Sequence
  Description of Artificial Sequence: Synthetic polypeptide <220; FKBP(F36V)-EpoR(237-338;L241G,L242P)-IFNAR1(300-520)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 236 - protein, 413 aa, Artificial Sequence
  Description of Artificial Sequence: Synthetic polypeptide <220; FKBP(F36V)-muEpoR(236-337;L264G,L265P)-muIL2Rb(337-539)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPASLLTASDLDPLILTLSLILVLISLGPTVLALLSHRRTLQQKIWPGIPSPESEFEGLFTTHKGNFQLWLLQRDGCLWWSPGSSFPEDPPAHLEVLSEPRAVQLLLLQKDSAPLPSPSGHSQASCFTNQGYFFFHLPNALEIESCQVYFTYDPCVEEEVEEDGSRLPEGSPHPPLLPLAGEQDDYCAFPPRDDLLLFSPSLSTPNTAYGGSRAPEERSPLSLHEGLPSLASRDLMGLQRPLERMPEGDGEGLSANSSGEQASVPEGNLHGQDQDRGQGPILTLNTDAYLSLQELQAQDSVHLI

SEQ ID NO: 237 - protein, 354 aa, Artificial Sequence
  Description of Artificial Sequence: Synthetic polypeptide <220; FKBP(F36V)-muEpoR(236-337;L264G,L265P)-muIL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPASLLTASDLDPLILTLSLILVLISLGPTVLALLSHRRTLQQKIWPGIPSPESEFEGLFTTHKGNFQLWLLQRDGCLWWSPGSSFPEDPPAHLEVLSEPRARDEVESFLPNDLPAQPEELETQGHRAAVHSANRSPETSVSPPETVRRESPLRCLARNLSTCNAPPLLSSRSPDYRDGDRNRPPVYQDLLPNSGNTNVPVPVPQPLPFQSGILIPVSQRQPISTSSVLNQEEAYVTMSSFYQNK

SEQ ID NO: 238 - protein, 405 aa, Artificial Sequence
  Description of Artificial Sequence: Synthetic polypeptide <220; FKBP(F36V)-EpoR(237-338;L241G,L242P)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 239 - protein, 395 aa, Artificial Sequence
  Description of Artificial Sequence: Synthetic polypeptide <220; FKBP(F36V)-GP130(609-700)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLETTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 240 - protein, 402 aa, Artificial Sequence
  Description of Artificial Sequence: Synthetic polypeptide <220; FKBP(F36V)-PrlR(221-319)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 241 - protein, 405 aa, Artificial Sequence
  Description of Artificial Sequence: Synthetic polypeptide <220; FKBP(F36V)-GHR(251-352)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLELPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 242 - protein, 400 aa, Artificial Sequence
  Description of Artificial Sequence: Synthetic polypeptide <220; FKBP(F36V)-GCSFR(614-710)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLELTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWEARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 243 - protein, 408 aa, Artificial Sequence
  Description of Artificial Sequence: Synthetic polypeptide <220; FKBP(F36V)-TPOR/MPLR(478-582)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 244 - protein, 251 aa, Artificial Sequence
  Description of Artificial Sequence: Synthetic polypeptide <220; FKBP(F36V)- EpoR(237-338;L241G,L242P)-IL7R(376-416)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLP

SEQ ID NO: 245 - protein, 246 aa, Artificial Sequence
  Description of Artificial Sequence: Synthetic polypeptide <220; FKBP(F36V)- EpoR(237-338;L241G,L242P)-IL7R(424-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGILTLNPVAQGQPILTSLGSNQEEAYVTMSSFYQNQ

SEQ ID NO: 246 - protein, 278 aa, Artificial Sequence
  Description of Artificial Sequence: Synthetic polypeptide <220; FKBP(F36V)- EpoR(237-338;L241G,L242P)-IL7R(376-416,424-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLPQGQPILTSLGSNQEEAYVTMSSFYQNQ

SEQ ID NO: 247 - protein, 246 aa, Artificial Sequence
  Description of Artificial Sequence: Synthetic polypeptide <220; FKBP(F36V)- EpoR(237-338;L241G,L242P)-IL7R(424-459;Y456F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGILTLNPVAQGQPILTSLGSNQEEAYVTMSSFFQNQ

SEQ ID NO: 248 - protein, 278 aa, Artificial Sequence
  Description of Artificial Sequence: Synthetic polypeptide <220; FKBP(F36V)- EpoR(237-338;L241G,L242P)-IL7R(376-416,424-459;Y456F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCACDAPILSSSRSLDCRESGKNGPHVYQDLLLSLGTTNSTLPQGQPILTSLGSNQEEAYVTMSSFFQNQ

SEQ ID NO: 249 - protein, 251 aa, Artificial Sequence
  Description of Artificial Sequence: Synthetic polypeptide <220; FKBP(F36V)- EpoR(237-338;L241G,L242P)-IL2Rb(393-433)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCDEGVAGAPTGSSPQPLQPLSGEDDAYCTFPSRDDLLLFSPS

SEQ ID NO: 250 - protein, 244 aa, Artificial Sequence
  Description of Artificial Sequence: Synthetic polypeptide <220; FKBP(F36V)- EpoR(237-338;L241G,L242P)-IL2Rb(518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCGQGEFRALNARLPLNTDAYLSLQELQGQDPTHLV

SEQ ID NO: 251 - protein, 292 aa, Artificial Sequence
  Description of Artificial Sequence: Synthetic polypeptide <220; FKBP(F36V)- EpoR(237-338;L241G,L242P)-IL2Rb(339-379,393-433)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQDEGVAGAPTGSSPQPLQPLSGEDDAYCTFPSRDDLLLFSPS

SEQ ID NO: 252 - protein, 285 aa, Artificial Sequence
  Description of Artificial Sequence: Synthetic polypeptide <220; FKBP(F36V)- EpoR(237-338;L241G,L242P)-IL2Rb(339-379,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQGQGEFRALNARLPLNTDAYLSLQELQGQDPTHLV

SEQ ID NO: 253 - protein, 285 aa, Artificial Sequence
  Description of Artificial Sequence: Synthetic polypeptide <220; FKBP(F36V)- EpoR(237-338;L241G,L242P)-IL2Rb(393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCDEGVAGAPTGSSPQPLQPLSGEDDAYCTFPSRDDLLLFSPSGQGEFRALNARLPLNTDAYLSLQELQGQDPTHLV

SEQ ID NO: 254 - protein, 326 aa, Artificial Sequence
  Description of Artificial Sequence: Synthetic polypeptide <220; FKBP(F36V)- EpoR(237-338;L241G,L242P)-IL2Rb(339-379,393-433, 518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 255 - protein, 441 aa, Artificial Sequence
  Description of Artificial Sequence: Synthetic polypeptide <220; FKBP(F36V)- EpoR(237-338;L241G,L242P)-EGFR(955-1186)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 256 - protein, 428 aa, Artificial Sequence
  Description of Artificial Sequence: Synthetic polypeptide <220; FKBP(F36V)- EpoR(237-338;L241G,L242P)-EGFR(955-1044,1058-1186; Y974F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFFRALMDEEDMDDVVDADEYLIPQQGFFSSPSTSRTPLLSSLSATSNNSTVACIDRNGLQSCPIKEDSFLQRIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 257 - protein, 264 aa, Artificial Sequence
  Description of Artificial Sequence: Synthetic polypeptide <220; FKBP(F36V)- EpoR(237-338;L241G,L242P)-EGFR(955-1009;Y974F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVIQGDERMHLPSPTDSNFFRALMDEEDMDDVVDADEYLIPQQGFFSSPSTSRTP

SEQ ID NO: 258 - protein, 264 aa, Artificial Sequence
  Description of Artificial Sequence: Synthetic polypeptide <220; FKBP(F36V)- EpoR(237-338;L241G,L242P)-EGFR(1019-1085)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCNNSTVACIDRNGLQSCPIKEDSFLQRIDDTFLPVPEYINQSVPKRPAGSVQNPV

SEQ ID NO: 259 - protein, 264 aa, Artificial Sequence
  Description of Artificial Sequence: Synthetic polypeptide <220; FKBP(F36V)- EpoR(237-338;L241G,L242P)-EGFR(1037-1044,1058-1103; Y1068/1101F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCKEDSFLQRIDDTFLPVPEFINQSVPKRPAGSVQNPVYHNQPLNPAPSRDPHFQD

SEQ ID NO: 260 - protein, 264 aa, Artificial Sequence
  Description of Artificial Sequence: Synthetic polypeptide <220; FKBP(F36V)- EpoR(237-338;L241G,L242P)-EGFR(1066-1118;Y1068/1086F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCVPEFINQSVPKRPAGSVQNPVFHNQPLNPAPSRDPHYQDPHSTAVGNPEYLNTV

SEQ ID NO: 261 - protein, 264 aa, Artificial Sequence
  Description of Artificial Sequence: Synthetic polypeptide <220; FKBP(F36V)- EpoR(237-338;L241G,L242P)-EGFR(1122-1165)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCPEYLNTVQPTCVNSTFDSPAHWAQKGSHQISLDNPDYQQDFFPKEAKPNGIFKG

SEQ ID NO: 262 - protein, 264 aa, Artificial Sequence
  Description of Artificial Sequence: Synthetic polypeptide <220; FKBP(F36V)- EpoR(237-338;L241G,L242P)-EGFR(1133-1186;Y1148F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCWAQKGSHQISLDNPDFQQDFFPKEAKPNGIFKGSTAENAEYLRVAPQSSEFIGA

SEQ ID NO: 263 - protein, 366 aa, Artificial Sequence
  Description of Artificial Sequence: Synthetic polypeptide <220; FKBP(F36V)- EpoR(237-338;L241G,L242P)-BLNK(53-208)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 264 - protein, 366 aa, Artificial Sequence
  Description of Artificial Sequence: Synthetic polypeptide <220; FKBP(F36V)- EpoR(237-338;L241G,L242P)-BLNK(53-208;Y72F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDFENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 265 - protein, 366 aa, Artificial Sequence
  Description of Artificial Sequence: Synthetic polypeptide <220; FKBP(F36V)- EpoR(237-338;L241G,L242P)-BLNK(53-208;Y72F,Y96F)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESEPVSGPTPSDLDPLILTLSLILVVILVGPTVLALLSHRRALKQKIWPGIPSPESEFEGLFTTHKGNFQLWLYQNDGCLWWSPCTPFTEDPPASLEVLSERCASESPADEEEQWSDDFDSDFENPDEHSDSEMYVMPAEENADDSFEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNR

SEQ ID NO: 266 - protein, 357 aa, Artificial Sequence
  Description of Artificial Sequence: Synthetic polypeptide <220; FKBP(F36V)- TPOR/MPLR(478-582)-IL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 267 - protein, 432 aa, Artificial Sequence
  Description of Artificial Sequence: Synthetic polypeptide <220; FKBP(F36V)- TPOR/MPLR(478-582)-IL2Rb(333-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 268 - protein, 288 aa, Artificial Sequence
  Description of Artificial Sequence: Synthetic polypeptide <220; FKBP(F36V)- TPOR/MPLR(478-582)-IL2Rbsmall(393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLV

SEQ ID NO: 269 - protein, 329 aa, Artificial Sequence
  Description of Artificial Sequence: Synthetic polypeptide <220; FKBP(F36V)- TPOR/MPLR(478-582)-IL2Rbsmall(339-379,393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 270 - protein, 408 aa, Artificial Sequence; identical to SEQ ID NO: 243
  Description of Artificial Sequence: Synthetic polypeptide <220; FKBP(F36V)- TPOR/MPLR(478-582)-IL7R(316-459)-IL12Rb2(775-825)

SEQ ID NO: 271 - protein, 574 aa, Artificial Sequence
  Description of Artificial Sequence: Synthetic polypeptide <220; FKBP(F36V)- TPOR/MPLR(478-582)-IL7R(316-459)-IL21R(322-538)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 272 - protein, 574 aa, Artificial Sequence
  Description of Artificial Sequence: Synthetic polypeptide <220; FKBP(F36V)- TPOR/MPLR(478-582)- IL21R(322-538)-IL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 273 - protein, 505 aa, Artificial Sequence
  Description of Artificial Sequence: Synthetic polypeptide <220; FKBP(F36V)- TPOR/MPLR(478-582)-IL2Rbsmall(393-433,518-551) -IL21R(322-538)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLVPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 274 - protein, 505 aa, Artificial Sequence
  Description of Artificial Sequence: Synthetic polypeptide <220; FKBP(F36V)- TPOR/MPLR(478-582)- IL21R(322-538) -IL2Rbsmall(393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASDEGVAGAPTGSSPQPLQPLSGEDDAYCTFPSRDDLLLFSPSGQGEFRALNARLPLNTDAYLSLQELQGQDPTHLV

SEQ ID NO: 275 - protein, 546 aa, Artificial Sequence
  Description of Artificial Sequence: Synthetic polypeptide <220; FKBP(F36V)- TPOR/MPLR(478-582)-IL2Rbsmall(339-379,393-433,518-551) -IL21R(322-538)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLVPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 276 - protein, 546 aa, Artificial Sequence
  Description of Artificial Sequence: Synthetic polypeptide <220; FKBP(F36V)- TPOR/MPLR(478-582)- IL21R(322-538) -IL2Rbsmall(339-379,393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQASQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 277 - protein, 432 aa, Artificial Sequence
  Description of Artificial Sequence: Synthetic polypeptide <220; FKBP(F36V)- TPOR/MPLR(478-582)-IL2Rbsmall(393-433,518-551) -IL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLDEGVAGAPTGSSPQPLQPLSGEDDAYCTFPSRDDLLLFSPSGQGEFRALNARLPLNTDAYLSLQELQGQDPTHLVARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 278 - protein, 432 aa, Artificial Sequence
  Description of Artificial Sequence: Synthetic polypeptide <220; FKBP(F36V)- TPOR/MPLR(478-582)-IL7R(316-459) -IL2Rbsmall(393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQDEGVAGAPTGSSPQPLQPLSGEDDAYCTFPSRDDLLLFSPSGQGEFRALNARLPLNTDAYLSLQELQGQDPTHLV

SEQ ID NO: 279 - protein, 473 aa, Artificial Sequence
  Description of Artificial Sequence: Synthetic polypeptide <220; FKBP(F36V)- TPOR/MPLR(478-582)- IL2Rbsmall(339-379,393-433,518-551) -IL7R(316-459)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLVARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 280 - protein, 473 aa, Artificial Sequence
  Description of Artificial Sequence: Synthetic polypeptide <220; FKBP(F36V)- TPOR/MPLR(478-582)-IL7R(316-459) - IL2Rbsmall(339-379,393-433,518-551)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQQQDKVPEPASLSSNHSLTSCFTNQGYFFFHLPDALEIEACQDEGVAGAPTGSSPQPLQPLSGEDDAYCTFPSRDDLLLFSPSGQGEFRALNARLPLNTDAYLSLQELQGQDPTHLV

SEQ ID NO: 281 - protein, 408 aa, Artificial Sequence
  Description of Artificial Sequence: Synthetic polypeptide <220; FKBP(F36V)-PD1(156-191)-TPOR/MPLR (514-582)-IL7R(316-459) -IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEPSPSPRPAGQFQTLVVGVVGGLLGSLVLLVWVLAVIRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 282 - protein, 267 aa, Artificial Sequence
  Description of Artificial Sequence: Synthetic polypeptide <220; FKBP(F36V)- TPOR/MPLR(478-582)-EGFR(1122-1165)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLPEYLNTVQPTCVNSTFDSPAHWAQKGSHQISLDNPDYQQDFFPKEAKPNGIFKG

SEQ ID NO: 283 - protein, 408 aa, Artificial Sequence; identical to SEQ ID NO: 243
  Description of Artificial Sequence: Synthetic polypeptide <220; FKBP(F36V)- TPOR/MPLR(478-582)-IL7R(316-459)-IL12Rb2(775-825) FKBP switch containing  wildtype TpoR TM sequence

SEQ ID NO: 284 - protein, 407 aa, Artificial Sequence
  Description of Artificial Sequence: Synthetic polypeptide <220; FKBP(F36V)- TPOR/MPLR(478-582;N-1)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETWISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 285 - protein, 406 aa, Artificial Sequence
  Description of Artificial Sequence: Synthetic polypeptide <220; FKBP(F36V)- TPOR/MPLR(478-582;N-2)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 286 - protein, 407 aa, Artificial Sequence
  Description of Artificial Sequence: Synthetic polypeptide <220; FKBP(F36V)- TPOR/MPLR(478-582;N-2+1)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 287 - protein, 405 aa, Artificial Sequence
  Description of Artificial Sequence: Synthetic polypeptide <220; FKBP(F36V)- TPOR/MPLR(478-582;N-3)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETSLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 288 - protein, 404 aa, Artificial Sequence
  Description of Artificial Sequence: Synthetic polypeptide <220; FKBP(F36V)- TPOR/MPLR(478-582;N-4)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 289 - protein, 405 aa, Artificial Sequence
  Description of Artificial Sequence: Synthetic polypeptide <220; FKBP(F36V)- TPOR/MPLR(478-582;N-4+1)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETILVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 290 - protein, 403 aa, Artificial Sequence
  Description of Artificial Sequence: Synthetic polypeptide <220; FKBP(F36V)- TPOR/MPLR(478-582;N-5)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 291 - protein, 402 aa, Artificial Sequence
  Description of Artificial Sequence: Synthetic polypeptide <220; FKBP(F36V)- TPOR/MPLR(478-582;N-6)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 292 - protein, 401 aa, Artificial Sequence
  Description of Artificial Sequence: Synthetic polypeptide <220; FKBP(F36V)- TPOR/MPLR(478-582;N-7)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 293 - protein, 400 aa, Artificial Sequence
  Description of Artificial Sequence: Synthetic polypeptide <220; FKBP(F36V)- TPOR/MPLR(478-582;N-8)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 294 - protein, 399 aa, Artificial Sequence
  Description of Artificial Sequence: Synthetic polypeptide <220; FKBP(F36V)- TPOR/MPLR(478-582;N-9)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 295 - protein, 398 aa, Artificial Sequence
  Description of Artificial Sequence: Synthetic polypeptide <220; FKBP(F36V)- TPOR/MPLR(478-582;N-10)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 296 - protein, 397 aa, Artificial Sequence
  Description of Artificial Sequence: Synthetic polypeptide <220; FKBP(F36V)- TPOR/MPLR(478-582;N-11)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 297 - protein, 396 aa, Artificial Sequence
  Description of Artificial Sequence: Synthetic polypeptide <220; FKBP(F36V)- TPOR/MPLR(478-582;N-12)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 298 - protein, 395 aa, Artificial Sequence
  Description of Artificial Sequence: Synthetic polypeptide <220; FKBP(F36V)- TPOR/MPLR(478-582;N-13)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 299 - protein, 394 aa, Artificial Sequence
  Description of Artificial Sequence: Synthetic polypeptide
  FKBP(F36V)- TPOR/MPLR(478-582;N-14)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 300 - protein, 393 aa, Artificial Sequence
  Description of Artificial Sequence: Synthetic polypeptide
  FKBP(F36V)- TPOR/MPLR(478-582;N-15)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 301 - protein, 392 aa, Artificial Sequence
  Description of Artificial Sequence: Synthetic polypeptide
  FKBP(F36V)- TPOR/MPLR(478-582;N-16)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 302 - protein, 391 aa, Artificial Sequence
  Description of Artificial Sequence: Synthetic polypeptide
  FKBP(F36V)- TPOR/MPLR(478-582;N-17)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 303 - protein, 390 aa, Artificial Sequence
  Description of Artificial Sequence: Synthetic polypeptide
  FKBP(F36V)- TPOR/MPLR(478-582;N-18)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 304 - protein, 409 aa, Artificial Sequence
  Description of Artificial Sequence: Synthetic polypeptide
  FKBP(F36V)- TPOR/MPLR(478-582;N+1)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 305 - protein, 410 aa, Artificial Sequence
  Description of Artificial Sequence: Synthetic polypeptide
  FKBP(F36V)- TPOR/MPLR(478-582;N+2)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 306 - protein, 411 aa, Artificial Sequence
  Description of Artificial Sequence: Synthetic polypeptide
  FKBP(F36V)- TPOR/MPLR(478-582;N+3)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 307 - protein, 412 aa, Artificial Sequence
  Description of Artificial Sequence: Synthetic polypeptide
  FKBP(F36V)- TPOR/MPLR(478-582;N+4)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 308 - protein, 413 aa, Artificial Sequence
  Description of Artificial Sequence: Synthetic polypeptide
  FKBP(F36V)- TPOR/MPLR(478-582;N+5)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 309 - protein, 414 aa, Artificial Sequence
  Description of Artificial Sequence: Synthetic polypeptide
  FKBP(F36V)- TPOR/MPLR(478-582;N+6)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 310 - protein, 415 aa, Artificial Sequence
  Description of Artificial Sequence: Synthetic polypeptide
  FKBP(F36V)- TPOR/MPLR(478-582;N+7)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWVLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 311 - protein, 416 aa, Artificial Sequence
  Description of Artificial Sequence: Synthetic polypeptide
  FKBP(F36V)- TPOR/MPLR(478-582;N+7)-IL7R(316-459)-IL12Rb2(775-825)
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESDPTRVETATETAWLVLLILVLISLVTALHLVLGLSAVLGLLLLRWQFPAHYRRLRHALWPSLPDLHRVLGQYLRDTAALSPPKATVSDTCEEVEPSLLEILPKSSERTPLPLARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQSDPKPENPACPWTVLPAGDLPTHDGYLPSNIDDLPSHEAPLADSLEELEPQ

SEQ ID NO: 312 - DNA, 20 bp, Artificial Sequence
  Description of Artificial Sequence: Synthetic oligonucleotide
ttggaaaatttgtttcatag

SEQ ID NO: 313 - DNA, 20 bp, Artificial Sequence
  Description of Artificial Sequence: Synthetic oligonucleotide
aactatgaaacaaattttcc

SEQ ID NO: 314 - protein, 55 aa, Artificial Sequence
  Description of Artificial Sequence: Synthetic polypeptide
SDPTRVETATETAWISLVTALHLVLGLSAVLGLLLLRWQFPAHYRRLRHALWPSL

SEQ ID NO: 315 - protein, 54 aa, Artificial Sequence
  Description of Artificial Sequence: Synthetic polypeptide
SDPTRVETATETWISLVTALHLVLGLSAVLGLLLLRWQFPAHYRRLRHALWPSL

SEQ ID NO: 316 - protein, 53 aa, Artificial Sequence
  Description of Artificial Sequence: Synthetic polypeptide
SDPTRVETATETISLVTALHLVLGLSAVLGLLLLRWQFPAHYRRLRHALWPSL

SEQ ID NO: 317 - protein, 54 aa, Artificial Sequence
  Description of Artificial Sequence: Synthetic polypeptide
SDPTRVETATETLISLVTALHLVLGLSAVLGLLLLRWQFPAHYRRLRHALWPSL

SEQ ID NO: 318 - protein, 52 aa, Artificial Sequence
  Description of Artificial Sequence: Synthetic polypeptide
SDPTRVETATETSLVTALHLVLGLSAVLGLLLLRWQFPAHYRRLRHALWPSL

SEQ ID NO: 319 - protein, 51 aa, Artificial Sequence
  Description of Artificial Sequence: Synthetic polypeptide
SDPTRVETATETLVTALHLVLGLSAVLGLLLLRWQFPAHYRRLRHALWPSL

SEQ ID NO: 320 - protein, 52 aa, Artificial Sequence
  Description of Artificial Sequence: Synthetic polypeptide
SDPTRVETATETILVTALHLVLGLSAVLGLLLLRWQFPAHYRRLRHALWPSL

SEQ ID NO: 321 - protein, 50 aa, Artificial Sequence
  Description of Artificial Sequence: Synthetic polypeptide
SDPTRVETATETVTALHLVLGLSAVLGLLLLRWQFPAHYRRLRHALWPSL

SEQ ID NO: 322 - protein, 49 aa, Artificial Sequence
  Description of Artificial Sequence: Synthetic polypeptide
SDPTRVETATETTALHLVLGLSAVLGLLLLRWQFPAHYRRLRHALWPSL

SEQ ID NO: 323 - protein, 48 aa, Artificial Sequence
  Description of Artificial Sequence: Synthetic polypeptide
SDPTRVETATETALHLVLGLSAVLGLLLLRWQFPAHYRRLRHALWPSL

SEQ ID NO: 324 - protein, 47 aa, Artificial Sequence
  Description of Artificial Sequence: Synthetic polypeptide
SDPTRVETATETLHLVLGLSAVLGLLLLRWQFPAHYRRLRHALWPSL

SEQ ID NO: 325 - protein, 46 aa, Artificial Sequence
  Description of Artificial Sequence: Synthetic polypeptide
SDPTRVETATETHLVLGLSAVLGLLLLRWQFPAHYRRLRHALWPSL

SEQ ID NO: 326 - protein, 55 aa, Artificial Sequence; identical to SEQ ID NO: 314
  Description of Artificial Sequence: Synthetic polypeptide

SEQ ID NO: 327 - protein, 56 aa, Artificial Sequence
  Description of Artificial Sequence: Synthetic polypeptide
SDPTRVETATETAWLISLVTALHLVLGLSAVLGLLLLRWQFPAHYRRLRHALWPSL

SEQ ID NO: 328 - protein, 57 aa, Artificial Sequence
  Description of Artificial Sequence: Synthetic polypeptide
SDPTRVETATETAWVLISLVTALHLVLGLSAVLGLLLLRWQFPAHYRRLRHALWPSL

SEQ ID NO: 329 - protein, 58 aa, Artificial Sequence
  Description of Artificial Sequence: Synthetic polypeptide
SDPTRVETATETAWLVLISLVTALHLVLGLSAVLGLLLLRWQFPAHYRRLRHALWPSL

SEQ ID NO: 330 - protein, 59 aa, Artificial Sequence
  Description of Artificial Sequence: Synthetic polypeptide
SDPTRVETATETAWILVLISLVTALHLVLGLSAVLGLLLLRWQFPAHYRRLRHALWPSL

SEQ ID NO: 331 - protein, 60 aa, Artificial Sequence
  Description of Artificial Sequence: Synthetic polypeptide
SDPTRVETATETAWLILVLISLVTALHLVLGLSAVLGLLLLRWQFPAHYRRLRHALWPSL

SEQ ID NO: 332 - protein, 61 aa, Artificial Sequence
  Description of Artificial Sequence: Synthetic polypeptide
SDPTRVETATETAWLLILVLISLVTALHLVLGLSAVLGLLLLRWQFPAHYRRLRHALWPSL

SEQ ID NO: 333 - protein, 62 aa, Artificial Sequence
  Description of Artificial Sequence: Synthetic polypeptide
SDPTRVETATETAWVLLILVLISLVTALHLVLGLSAVLGLLLLRWQFPAHYRRLRHALWPSL

SEQ ID NO: 334 - protein, 63 aa, Artificial Sequence
  Description of Artificial Sequence: Synthetic polypeptide
SDPTRVETATETAWLVLLILVLISLVTALHLVLGLSAVLGLLLLRWQFPAHYRRLRHALWPSL

---

The invention claimed is:

1. An inducible chimeric cytokine receptor comprising at least two identical polypeptide monomers each comprising an N-terminal to C-terminal orientation of:
- an FK506 Binding Protein (FKBP) extracellular dimerization domain comprising the amino acid sequence of SEQ ID NO:218;
- an intracellular tyrosine kinase activating domain comprising the wild-type thrombopoietin receptor (TPOR/MPLR) tyrosine kinase activating domain amino acid sequence of SEQ ID NO: 96; and
- an intracellular tyrosine effector domain comprising at least two STAT-activation domains obtained from two cytokine receptors,
- wherein the at least two STAT-activation domains comprise the interleukin-7 receptor (IL7R) amino acid sequence of SEQ ID NO: 134 and the interleukin-12 receptor b2 (IL12Rb2) amino acid sequence of SEQ ID NO: 155 in tandem.

2. The inducible chimeric cytokine receptor of claim 1, wherein the extracellular dimerization domain binds to a ligand AP1903, AP20187, dimeric FK506, or a dimeric FK506-like analog.

3. The inducible chimeric cytokine receptor of claim 1, wherein the inducible chimeric cytokine receptor comprises a membrane-targeting motif.

4. The inducible chimeric cytokine receptor of claim 3, wherein the membrane-targeting motif comprises a myristoylation motif.

5. The inducible chimeric cytokine receptor of claim 1, wherein the receptor is myristoylated.

6. The inducible chimeric cytokine receptor of claim 1, wherein each polypeptide monomer comprises the sequence of SEQ ID NO: 46.

7. The inducible chimeric cytokine receptor of claim 1, wherein each polypeptide monomer comprises the sequence of SEQ ID NO: 19.

8. The inducible chimeric cytokine receptor of claim 1, wherein each polypeptide monomer comprises the sequence of SEQ ID NO: 243.

* * * * *